United States Patent 12,371,699 (NUCLEIC ACIDS ENCODING CRISPR-ASSOCIATED PROTEINS AND USES THEREOF) - sequence listing, part 9

SEQ ID NO: 6691 - RNA, 4146 nt, synthetic construct
  misc_feature 1..4146: note = Cas9 variant
  source 1..4146: mol_type = other RNA
atgaaacaaatcctgaagaaagtacaaggctacaacatcggcctagacattgggacgaacagcgtcggatgggtagtcaccgacgagaacgctaacctgctccagttccgcaagaagaacatgtggggcgcccgcttgttcgaaaaaggggacaccgcacaagggcgaagactcagtcgatcaactcgaagacgatacgaccgacgccgacagcgaatccactatctccaagaaatgctagccaccatggtactgcccatcgatgaatcattcttcattcgactcaacgaggcctttctgtggaaggaggacaaaagtgtccaaagagactacatcctatttgcggacaagcagttcacagaccgcgacttctacaaacagttcaaaacaatataccatctccgcaagttcttactagacacaaaagaaaaggcggacccaagattcatatacctcgcacttcaccacatgatcaagtaccgggggaacttcctataccagggacagtcatttgacgtagtcgaaaatgtccaagaatccttccgcgtgctcctcgaagagatgtacgagcaacttggcaaggagtgggagtacggggagcacttcgacgacatccagcgcatactcgaaaacacaacaatcgggaagaaatcaaaacaggagcaaatcgccgcaatcctcaccgagcagtacgggaacaagaaactcgccaacgaggtaacacgcgcatgcctaggatactccttcgacctcaccgtcgtgatggaaaacgagaacctcctcgacgaatccggaaagaaaatcaaaatcagtttctcagacagtaaatacgaggagcaagagctagaactgcaaaaccggctcgaagaaaaattcgcagtaatcgaagcattaaaaaggatctacaactggctggtactgaaagacacacttcgaggaaagaagtatatctcagaggccatggtaaacaagtacgaagcccaccacgaagatctcgtcaaactcaaacgacttttccgcacctacctgagcacggaggaatattcctgctttttcaggaaagaaaaacaaaaagacaaatacatatcgaactacgtaaactacaggaagggggccgaacgttgctcaaaggaaaaactatataaagcgatccacgagttgtttgacactgtggccaaagacgacgtcgtataccaggaaatcgtcgagaagatggaccaaggcgagttcctcacgaagcaaaacgaagtaagcaacgcctacatcccatatcaatgcaatgaagtcgaaatgaagagaatattaaaacaacagggggagttctaccccgaactaaaggaaaacgcggacaagattctacaactactactcttccggattccctactacgtcggcccccttgtcgacgaaaagcagagcaagttcgcatggatgaagcgccgaacgggcatggaacaagttaagatctacccgtggaacttcgaacaggtcgtcgacatagaccaaaccgcagaggctttcataacgcggatgacgaactattgcacctacctcccagaagaaaaggtactgcctaaacaaagcctactgtacagcgagtacgagctcctacaggaactcaacaaaatcaaaatcaatggaaagttcagcctggaaacccgtaataaaatcatcgagcaactctttaagaaacagaagaaagtaaccgaaaaacaactgaagaagtggctagtgagggagcaatactgcacgacgaaggtcaccgagaagatggtcaaactcgacgagaacgcgtactacatcacggggttccagaaagagaacgagttcgccagcagcctaaccagctacatcgacttcacgaagatactcggagaaataaccgaacgtaaccgcaaaatgatagaagaaatcatatactggctaacggtgttcgaagaaaagtccatcgtcaaacgaaagattcaaaagaaatatggcaacgaaatcaacgataaacaactcgcacaaatcctcaaactcaactacagcggatgggggcggttcagcgagaaattcctaaacggaataaaaggcttcgaccggcaagggcaaaagaagacaatcatggaactgctcagggaagatagccggctgcttaacataatgcagataattaataacgaagaaatggggttttgcaagataatcgaggcaaaccaaaagaagctctacggtaacgagaacctgctcgatgtagtacaggaattgcacggaagtcccgcaataaaacgcgggatatggcaatcactgaaaattgtagaagaaatcatcagtatcatgggaggggtcccccaaaacatcttcatcgagttcgcccgggaagatgacgacagggtaagaaccaactcccgcgtcaaacaaatcgaacggctctacaagaagttcaaagaggaggtgaacgacttcaacgaacacgctgcaaacgaactcaaggagaaaagatatcaaaacagaatcgacgaagaaaaggtcttcctatactttatgcaaaacgggaaaagcctgtacagcggcgtaacactggacatcgaccggctgaacgaatacgaagtagaccacataatcccgcgaacgctcgtcaaagacgactccctagaaaacaaagcgcttgtgctaaaaggcgaaaatcaacgcaagggcgaaggactgatcccacacgagtggcagaacaggcaaaaggaagtatggaagaaactcctgtcctgtggcctgatgggcaagaagaaatatgcaaatctgtgcaaagagagcttcggaaatgaaaaagagcagaaacacttcatcgcgcgacaaatagtggaaactcgacaaatcataaaacaagtggccaacattctcgcccagtactaccaaggggtgaacgtagccgcagtcaaagcctccctcggatccgaactccgggaaaactacacaatcgaaaagaaagacgacaacggattcttcatggagaacaaaagttacacaatgttaaaatcgcgaaaaatcaacgacttccaccacgcccaagacgcgtacctcgcctgcgccgtgggcctatacatcaaagcagctttccccaaatacgaaaaagaaatcgactacgaagggtacagaaaatactaccagaagaaaaaccagcaaaaagacggggtaagaaatgagaagcgacagttcttcagctatgtgatgtcgcgcttcagcgaacaaatagtcgataaagagaccggcgaaatcctatgggacggcacgcaaaagctagcgtacatcaagaaaatcttcggttaccgagactgcctaataacgaagaaacttgaagaaaacaccggagagttctacaaacagaccatcaatgcaaaacccgaaaaaggcaaagaaaataacacaaaactcctacccatcaagaaggggctaagcgtagagaaatacggaggctaccagggaggcgaagccgcctactcgtgcctggtccgctaccagcaagggcgcaaaacaaagttaagccttgaaaagatatcagtaataatagccaagaaaatagccgagaaagaagtaagcctcgaccgctacctgaaggaaaaactgggggttgaagaaatagtgatcctacgcaagaaggtaatgaaaaaccaacttatagaggacagcgacggcaacaggttctacctcaccgccgccaccgaggtcgtcaacgcgaagcagttcatcctagacggaaaacaccaacacctcctaaggactatcgcaataatggagaaaggtgagtattacggataccgcctcgacgaactcgaaaatagtatggacgaactatatgcatactaccggatgaagatccaacagcagtacccggcgtacgagtcgatagtaaagaaaatcgtagaaagccacgtgtacgaatcacttcacgtggaagagaaaataaaagccgtgcaggaaaaagggaaattcctcatccaactactcagactcaccgaagcaaacgccgaatgcatagacttgaaaacgatcagcgacgggagactggccgaccggatagggcgcaagaaccactacaccataaaggaaggaatcaaattcatcgaccagagcatcacgggactctacgaacgatatatgacagtctga

SEQ ID NO: 6692 - RNA, 4146 nt, synthetic construct
  misc_feature 1..4146: note = Cas9 variant
  source 1..4146: mol_type = other RNA
atggactatgtcaaggagtaccacatagggctagacatcggcacgtctagcatcggctgggctgtaacagacagccagtttaaactaatgcgaatcaaaggtaagacagccatcggagtccgcctctttgaggaagggaaaaccgcagcggaaagacggacatttagaacgaccaggagacgcctaaagcgccgtaagtggcgccttcactacctcgacaagatatttgcgccacacctacaggaagtagacgagaacttccttcgccgcctcaaacaaagcaacattcaccccgaagaccccgcgaagaaccaggcattcatcggaaagctcctcttccctgacctactcaagaaaaacgaacgcggttacccaacactgataaaaatgagagacgaactcccagtggagcagagggcacactacccggtcaccaacatctataaactccgagaagcaatgataaacgaagaccggcaattcgacctgcgcgaagtttacctagctgtccatcatatagtaaaataccgaggccacttcctgaacaacgcaagcgtcgacaagttcaaggtgggccgtatagacttcgataagtcattcaacgtcctaaacgaagcctacgaagaactgcaaaacggggaaggcagcttcacgatagaaccatccaaagtagagaaaatcggacagctcttactagatacaaagatgcgcaaacttgacagacaaaaagccgtcgccaaactcctagaagtgaaagtggccgacaaagaggagaccaaacggaacaaacagatagcgacagccatgtctaagttagtactaggatacaaggcagacttcgccaccgtcgccatggcgaacggcaacgagtggaaaatagacctcagctccgaaacgagtgaagacgaaatcgaaaagtttcgggaggaactgtccgacgctcaaaacgatatcctaaccgaaataacgagcctcttctcccaaattatgctaaatgcgatcgtcccaaacggaatgagcataagcgaaagcatgatggaccgatactggacacacgagcgacagctcgccgaagtaaaagaatatctggcaacgcaacccgcaagtgcacggaaggagttcgaccaagtctacaacaaatacataggccaagtacccaaagaaaaaggattcgaccttgaaaaggggctaaagaaaatcttaagcaagaaagagaactggaaggaaatcgacgagctcctgaaagcaggggactttctccccaaacagaggacaagcgcgaatggagtcatcccacaccaaatgcaccaacaagaactcgacagaatcatcgaaaaacaggcaaaatactacccctggctcgccactgagaaccccgccactggcgagcgcgataggcaccaagccaaatacgagctggaccagctagtctccttcagaataccgtactacgtaggcccactcgtcacaccggaggtgcaaaaagccacctccggtgcaaaattcgcctgggctaaacgaaaagaagatggcgaaatcaccccctggaacctctgggacaagatcgaccgagcggaaagcgccgaagcattcataaaacgcatgactgtcaaagacacatacctcctcaacgaggacgtactccccgcaaacagtctgctataccaaaaatataacgtcctgaacgaactaaacaacgttcgggtaaatggacggcggttatcagtaggcataaagcaagacatttacacggagctgttcaaaaagaagaaaacagtcaaagccggagacgtcgcctcccttgtaatggcgaaaacacgcggcgtaaataaacccagcgtcgaaggcctatccgatccaaagaaattcaactctaacttagcaacctacctcgacctcaaaagtataatgggcgacaaagtggatgacaaccgctaccagatggacctcgagaacatcatagaatggcggagtgtcttcgaagacggcgagatattcgcagacaagctgacagaggtagaatggctcaccgacgaacagcgatccgcgctcgtaaagaaaagatataaaggctggggtcgactctccaagaaacttctaacagggattgtcgacgaaaatggccaacgcataatagatcttatgtggaacaccgatcaaaacttcatgcaaatcgtgaaccaacccgtattcaaagagcaaatagatcagcttaaccaaaaagcaatcaccaacgacggcatgaccctaagagagcgagtagaatccgtacttgacgacgcctacaccagtccccaaaacaagaaagccatctggcaggtagttcgagtggttgaagacatcgtcaaagcggttggcaacgcaccgaaatctatctccatcgagttcgcacgaaacgaagggaacaaaggagaaatcacacgctcgagaagaacccaactacaaaaactgttcgaagatcaggcacatgagctagtaaaagacaccagcctcacagaggaactcgaaaaggctccggacctgagcgaccgatactacttctacttcacccaaggcggtaaagacatgtacaccggcgacccaatcaacttcgacgaaatatccaccaaatatgatatagaccacatcttaccgcaaagtttcgtaaaagacgatagcctcgacaatcgagtccttgtatcgcgagcggaaaacaacaagaaatcagaccgcgtcccagcgaaattatacgccgcaaaaatgaaaccttactggaaccaactactaaaacaaggcctcataacacagaggaaattcgaaaatctcacaatggacgtagaccagaacataaaatacaggtcactagggttcgtcaagcgccaactcgtagagacgagacaggttataaagctcaccgcaaacatactaggatcgatgtaccaagaggcaggaacggacatcatagaaactcgagcgggtcttaccaaacagctcagagaggagttcgacctccccaaagtccgcgaagtgaacgactaccaccacgcggtagacgcgtatctaaccacctttgcaggccaatacctaaaccgccgatacccgaagctccggtccttctttgtctacggcgaatacatgaaattcaaacacggaagcgacctcaagttacgcaacttcaactttttccacgaactaatggaaggggacaagtcacaaggaaaagtcgtcgaccaacaaaccggcgaactcataaccacgagggacgaagtcgctaagagcttcgacagactcctgaacatgaaatacatgctggtatcgaaagaagtccatgaccgtagtgaccagctctatggagcaacaatagtcacagccaaagagtcgggaaagctgacctccccaatagagataaagaaaaatcgccccgtagacctgtacggggcctacacaaacggcacctccgcattcatgaccatcatcaagttcaccgggaacaagccaaaatacaaagtaataggagttccaaccacctccgcggtgggcctcaagcgcgtcggcaaaccaggaagcgagtcctacaaccaagaactccaccgaataatcaaatctaaccccaaagttaagaaagacttcgagattgttgtaccacatgtaagctactcacaactcattgtcgacggagactgcaaattcacccttgccagcgacacttaccagcacccagcaacgcagctagttctctccaaagaaagcatggaaataatcgctgacgacttcaaattcgtcaaagaaaatcccgccaccgcagatgaacaactcgtccgagtcttcgacgagatcgtaaaccagatgaaccactacttcacaatcttcgaccaacgatcgaacagacaaaaagtaacgaaagcgcgcgacaagttcgtatccctacccaccgaaagcgaatacgaaggggccaaaaagacacaggtcggaaaaacagaagttatcaccaacctattgatgggcctgcacgccaacgcggcacagggtgacctcaaggtccttggcctatccacattcggcttcttccaaagctcgggagggctcaacctcagcgaagacgcgatgatcgtgtaccaatcacccacggggttgttcgagcgacggatatgcctaaaggacatctga

SEQ ID NO: 6693 - RNA, 4146 nt, synthetic construct
  misc_feature 1..4146: note = Cas9 variant
  source 1..4146: mol_type = other RNA
atgaagaaatcctacgccatcggcatcgacatcggcaccaactccgtcggccattgcgtcatgtatactgaaaactacaaagtacccagcaaaaagatgaaagtattcggcaacaccgaaaaacgatacatcaagaaaaacctgttaggtaccctgctattcgatgagggcaacacagccgaaaaccggaggctaaagcgaaccgcccgccgtcggtataccagacgacgcaacagaatcttatatctccaagagatcttcgccgaagaaatcaacaaaatcgacgattctttcttccaacgcctggatgacagtttcctcatagtcgaagacaagcaaggctcaaaacacccgatcttcgggaccctacaagaagaaaaagaataccataaacaatttcccacgatctatcacctccggaaacaactagccgacagctcacagaaggccgacataaggctgatatatctagccctcgcccacattatcaagtaccgaggccacttcctcttcgaaggagacctaaagagtgaaaataaagacgtccaacatctattcaacgacttcgtggagatgttcgacaaaactgtcgagggctcatacctaagcgagaatctacccaacgtagccgacgtactcgtggagaaagtctcaaagagccgacgcctcgaaaacatcctgcactacttcccgaacgagaagaaaaatggcctgttcgggaacttccttgcactcgcgctcggacttcaacccaacttcaaaacaaacttcgaactcgcagaggacgccaaaatccaattctctaaagaaacgtacgaagaagacctggaggaactactgggcaagataggcgacgactatgcggacctcttcatagcgacgaaatccttatatgacggcatcctcctagccggaatactctcaacaaccgactcaactacgaaagcgcctttgagctcgtctatggtcaaccgctatgaggaacaccaaaaagaccttgccctccttaaagacttcattcgacaaaacttatccgactcatacaaggagttcttcaacgatacgctgaaagacggctacgcgggctatatcgaaggaaagaccacccaggaaaacttttaccgcttcataaagaaagccatcgagaaaattgaaggaagcaactacttcattgacaaaattgacagggaagacttcctgagaaaacaacggacattcgacaacggatccataccccaccagatccatctacaagaaatgcacgcaatcattcggcgccaagcagagttctacccattcctagtagaaaaccaggacaaaatagaaaagatacttactttccgtataccctactatgtggggccccttgccagaggcaagtccgaatttgcatggcttaaaagaaaatcagacgagaaaattcgcccctggaacttcgacgaaatggtcgacaaagaaacatcagccgaaaacttcatcacccgcatgactaactacgaccaatacctaccggaccagaaagtcctacccaaacacagcctactctacgaaaaattcgctgtatacaacgaactcaccaaagtacgctacgtaactgaacaaggaaaatccttcttcttcgatgcgaacatgaaacaagaaatattcgacggggtcttcaaagtttaccgcaaagtcaccaaagaaaaattaatggacttcttgggcaaagaatttgatgagttcagaatagtcgatcttatgggcctcgataaagacaacaagtcattcaacgcatccctgggaacctatcacgacttgaagaaaatagtcagcaaagacctccttgataacccagaaaacgaggacatcctagaaaacgtcgtcctaaccctcacgctattcgaagaccgcgagatgattcgcaaacgactcgagaaatacaaagacgtacttaccgaagaacaaagaaagaaactagagcgacgccattacactggatggggccgactgagcgcgaaactcatcaatggcatccgcaacaaaaccacacgaaaaaccattctagattatcttattgatgacggcacttcaaacagaaacttcatgcaactaatccacgatgacactctgagcttcgtcgacgaaatccgccttgcgcaaggctcaggcgaagccgaagattaccggaccgaagtccaaaacctagccggtagcccagcaattaaaaaggggatcctccaatcgttaaaaatcgtggatgagcttatcggtgtgatgggatacaatccagaacacgttgtagtagaaatggctcgggaaaaccagttcaccaaccaagggcgccgcagtagccagcaacgatataaaaagatagaaaacgccatcaaaaacctggactcgaacctcaactcgaaaatcctgaaggagtacccgaccaacaatcaagcactccagaatgaccgcctcttcctttactacctccaaaacggcaaagacatgtacaccgacgaagaactcgacattgatcaactaagccagtacgacatcgaccacatcatcccccaggccttcatcaaagacgactcgctcgacaataaggtactcaccaaaagcgcaaagaacaggggcaaatccgacgacgtaccctccctagagatcgtacataaaaagaaaaacttctggaaacaactccttgactcacaactgatctcccaacgcaaattcgataacctaacaaaagccgagaggggcggtctaacgaatgaagacaaagccagattcatccaacgccagctcgtcgaaacgcggcaaattactaagcacgttgcccgcatcctggatacccgattcaacacaaaacttgatgatgcaggaaacagaatccgcgaccccaaagttaacataatcacactgaaatcaagcctcgtctcgcagttccgcaaagattaccaactctacaaagttagagaaatcaacaactaccaccacgcgcacgacgcttacctaaacgccgtagtcgccacagcactcctcaagaaatacccccagctcgccccagagttcgtctacggcgactaccccaaatacaacagctacaaaagccgcaaaagcgccaccgaacgggtgctattctactccaatatcatgaacttctttaagagagtcgtgaaatcttcaaagaccggcaccgtaaaaatccgccccattattgaagtgaacaaagaaactggggaaatcgtttgggacaagaaaagcgacttccggaccgtccgtaaagttcttagctacccacaggttaacgtcgtcaagaaaaccgaagtgcagaaccacggactcgaccgcggaaaaccaaaaggcttctacaacgctaatctgagtcctcgaccgaaggaaggctcagtcgaaaacctcgttcccgccaagcaatccttcgacaccaagcgctatggcggctatgcagggatatcaaattcatacgccgttctggtcaacggcataatagaaaaaggaaagaaaaagagtaaagccgaagttactgagttccaaggcatttcaatcctggcccgtaaggatttcgagaaaaaccccaaacagtacctcctgaacctcggatacaaagacatcaaatccatcatcaaactgccgaaatactcactatttgaacttgaaaacggctcacgccgaatgctcgcctccatcctctccaccaacaataagcgaggcgagattcacaaagggaacgaaatgtatctccctgacaaatttgtcacgctcctctaccatgcaatgcgcgtcaaccggactctagaaccgggacacaagaaatacgtggagacccaccgccacgttttcgacgaactacttacttatatccttgaatacaacgagaaaatcgtcggcgccaaagccaacggcaaacgcattgtggaggcatacagcgcacggaaggacactgacaacctcgaggagctctgtaacagcttcataaatctactcaacttaaccgcactcggatcagcagtcgacttcgagttcctaggcactaaaatcccacgctaccgggactacacacccagctcactcctaaaagccactctcattcaccaatctgtcacaggactctacgaaacaaggatagacctctccaagctgggaggagactga

SEQ ID NO: 6694 - RNA, 4146 nt, synthetic construct
  misc_feature 1..4146: note = Cas9 variant
  source 1..4146: mol_type = other RNA
atgaagaaaataataggcttagacctgggaacaacgtcgataggctgggcatacgtgcacgaagccgaatccgcacaagaacggagtgagatagtaagactaggcgccagggttgtaccactcacaaccgacgaacaagacgaatttaaaaagggaaagagcataaccacaaacgcagcccgactcagcaaaagatcattgaggcggaacgcagacagattccaacttagacgcgatgaactcgccggggtaatgaaagaggcaggatggatcgacgaaacaacggttctagcagaacaggggcccagatccaccttcgaaacactacgacttcgcgcaaaggcagctagcgaggaagtaaccctggcggagttcgcccgcatactgctgcagatcaaccggaagcgagggtacaaaagcaaccgcaaaaccgacggcgacgaagaaggcgctctcatagacggaatggacgtctctaaacagctgaacgcaagcggccagactcctggagaatgggtgttagcccgaatgcaagagggcaacgcggtcatccccgcattctactgttcagacctaagcgaggagctagatcgaatctggagaaaacagcaagcctctcatcaagcgtggatgaccgaggaacttcacaccgttttacgccacgccgacgggagatccgcgatacgacttatggataaggcaggcgtagtacccgactcggtcaacgtaaaggagcgaagacgagtaatgtacgaatggcgcgccgccgcggtccgagactgcctgcccgccggacgcgtggccgcggccttaatgcaagtgagtaaagaaataggcagagcagactcgtacctgggcagaatcggcgaccgatcgaaggaactttacttccaccggcaaacggtgggccaatacctctggcgcttgatctgtgacaacccgaaccaatcgctcaaaaacctcgtcttttaccgacaagactaccaacacgagttcgagaccctatggagcatacagaccaaataccacgtcgaacttaccgaggacctaaggaaacgcgtagggaggatcatcttcttccagcgccccctgaaaagtaagaaaggtctagttaaccgatgcgagctagtacactatagcgtgtgcgaaaactcgggagacgacctaacggagaaagtagacgtgggaccaaaagtctgccccaaatcaagccccctgttccaagagttcaaggtgtggcaagtgctcaacaacgtggaagtcatacatccatccacccaagaagcgagacggctcgaaatggaagaaaaagaactactagcaagcgagctcctgttccgggacagaatgaaaaagatagacgtactgaagctactcttcagtaactggcgagacctggatctgaactataaggagctggaagggaaccgaacaatggcagccttctaccgcgtatacgagcaagttatagcacaaacaggacatggagactacgattttgccaagatgcgcgccgcaaaagtcaaggagctggccgagggagtattcgccggcctaggctttgaagtaggactgctcacgttcgacgcagaactagattcaccagcctacgaacaacagccatgctataggctttggcatctgctgtatagttacgaaggcgacaaatcagcaacgggaaacaaatgtctgctgaagaaactgtgcagactaacaggaatgaatgcagagctagtcggcctatttatgcaaatacgattctccggggactacggcagcctaagcaccaaagccatgcggagaatactcccctacctcaaagccggaaacacctacgacgtcgcgtgtgaatacgccggctttcgccacagcgcgaggtcccttacgcgcgaagaattagcgcaaaaagaatacaaggactacctcgatttattaccccgaaactcacttagaaacccggtcgtcgagaaaatactaaaccagatgattcacgtagtaaacggactgtcatccacatacggcaagccagacgaaatccgcgtagaaatggcgcgcgagctaaagaaaagcgcacgcgagcgagaggagatgacctccgcgataagcaaaaccacgaaggaaaatgcagaaatcacggcaatcctacaacgggacttcggcctgcgatacgtctcgagaaacgacatcttgagatacaaactctactgcgaactgagaataaagggcaacggatgccgcacactgtactcgaacacatacatcaacccaaacgaattattcagcagggagttcgacatcgaacacataataccccaatcgcgtctattcgacgacagcttctccaacaaaacactggaatcaagaacagcaaacctcgaaaagggagaccgaacagcatgggactacgttaacgaaaaatacggcgccgaaagggccgacgaatacagagcacaagtcgaagccttataccgagacggaacgataagcaaagctaaacgggacaagctcctaatgcccggcgacaaaatcccagaagacttcatagacagagatatcagaaacacgcagtacatcgcaaagaaagcactcgaaatattcgaagacttcgtaccctcagtagtcgccacgtcaggaaacgtaacagcccgattaagagaggactggggacttgtcgatgtaatgaaagaactaaactggtcaaaatacgaaagtcaagggatggtgcacatcgaatacgaccgagatggacggcccatccgacgcatcgtagattggacaaaaagaaatgaccaccgccaccacgccatggacgcactcgcggtggcattcacaaagcgaagctacatacaatacctgaatcacctgaacgccagaaaggaagctacgagcgtcgcatacgccatccaacacaaagaaatggaactagatggatcaaatcggtggcgcttcaaatgcccgtttggcgaccgaagcgcattcagacgcgaagcaaaagcgcaactagaaagaatcctggtcagcatcaagtcgaagaacaaagtgctcacgcccagcgtcaaccgaacaaagaaaagagggggcttcaacaagaaagtagaatggacgccgaggggtgccctccacaacgaaaccgtctatggccggatccgaaggtacgatgtgaaagaactaagggtaggatcgtccttcacagcggaggtcatcggaaaagtcgcggatagcaggtaccgggcagcgttaatgcaccgactagccgagttcggtggagacccaaagaaagcattcaccggcaaaaacagcctcgagaaaaacccgctgtacaccgacgaagcccacacagcctgcgtaccaagctcggttaaagtagtaagtttcgtggaaatcggaacaataaggaaaggagtagatccaaacctaaacgtcgacaaagtcgtggacacgcacattaaaaacatactgcttgccagactatcagcatacggcggagacgccaaaaaggcattctccaatttagacgcggatccgatatggctcaacaaagaaaaaggcatcgcaataaagagagttaccataagcgacgactcggaagtgcgaccgatacacgtaaagagagacatgcgtggcaggctagtatgcgacgaacacggtagaccagtaccctcagactacgtccaactaagaaacaaccaccacgtcgcaatattcagggacgccaacggcgaactcaaagaacgagtagtgactttcttcgaagcagtagaacgcgtccgacaactgagaagtgaggggcgcgccgttgaggtcatagacaaaaactacaaatgcgaagaggggtggaccttcctcttcagtatgaaaataaacgagtacttcgtattcccagatgcagcaagtggcttcgacccccgggaaatcgatttaaccgacccagccaactatgccctcatatcaccccacctcttccgcgtacaaaaactctcatctaaagactactactttcgccaccacctagagaccacagtaaacgacgtcaaacagttacgcgacatcacgtggaaaagaatatcaagcctgcaggatctcgccggtaccgtaaaagtaagggtaaatcatatcggacaaatcgtcgcagtcggtgagtactga

SEQ ID NO: 6695 - RNA, 4146 nt, synthetic construct
  misc_feature 1..4146: note = Cas9 variant
  source 1..4146: mol_type = other RNA
atggtaaagaaaaagtacgcgatcgggatagacatcgggaccaacagcgtgggatggtccatcgttaccgatgactacaaggtccccagtaaaaagatgaaagtcttcgggaacaccgagaaacgctatataaagaaaaatctcctcggaaccctgctgttcgacgaaggcaacacagccgaaaaccggcgcctcaaaagaacagcccgacggcgatacacacggcggagaaaccgaatcctataccttcaggagatattcgccgaagagataaacaagatagacgactcattcttccagagattagacgatagctttctcatcgtggaggataaacaaggaagcaagcacccgattttcggcacgcttcaagaggaaaaagaatatcacaagcaattcccaaccatataccacctgaggaaacaattggccgactcctcccaaaaagcagacattcgcctaatctacctggctcttgcacacatcattaagtaccgaggtcacttcctattcgaaggagacctcaagtccgaaaataaggacgtgcaacacctcttcaacgacttcgtggagatgttcgataaaacggtggaaggttcatacctctccgaaaacctgccgaatgtggctgacgtgctagtagaaaaagtatcgaaatcccgacgcctagaaaatatcctccactatttcccgaacgaaaagaagaacggtcttttcggcaacttcctcgctctggccctagggcttcagcccaacttcaagacaaacttcgaactcgccgaggacgcaaaaatccaattcagcaaagagacctacgaagaggacctggaagaactcctaggcaagattggcgacgactacgcagacctattcatcgctaccaaatcgctttacgacggcatactccttgccggcatcttatccacaacggactccaccaccaaggcacccctgagctccagcatggtcaaccgctacgaggaacaccaaaaagaccttgcacttctcaaaaactttatacaccaaaatctaagcgacagctataaagaagtattcaacgacaaactcaaagatggctacgctgggtacatcgaaggcaaaacaacgcaagaaaacttctacaggttcatcaaaaaggctatagaaaagatcgaagggtcaaactacttcatcgacaaaatcgaccgagaagactttcttcggaaacaaagaaccttcgacaacggttcgataccccaccaaatacacctacaagaaatgcacgccatcatacgccgccaggccgagttttaccccttcctagtcgaaaatcaagataaaatagagaaaatactcacattccgcattccctattacgtcggcccactagctagaggcaaaagcgagttcgcctggctaaaccgaaaatctgacgagaaaatacgaccctggaacttcgacgaaatggtcgacaaagaaacctcagccgaaaacttcatcacacgcatgaccaattacgaccagtatctccctgaccaaaaggtcctgccaaaacacagcctgctctacgaaaagttcgctgtctacaacgaactcacgaaagtacgatacgtcaccgaacaaggaaagtccttcttcttcgacgccaacatgaaacaagaaatcttcgaccgaacatttaaggtgtaccggaaggtcactaaggaaaaactaatggacttcctctccaaggaatttgatgagttccggatcgtggacctcctggggctagacaaggacaacaaaagttttaacgcatccctaggaacgtaccatgacctaaagaaaatcgtgagcgaagactttcttgacaacagcgaaaatgaagacatcctcgaaaacgtcgtcctaaccctaaccctctttgaagaccgtgagatgattcgaaaacgcttagagaaatacaaagacgtactcaccgaggaacaacgaaagaaactcgaacgtcgacactacaccggatggggacgactctccgccaagctcattaacggcatacgggacaaagtgacgagaaagacgatacttgactacctcatagatgacggcacctccaaccgcaacttcatgcaactcatcaacgacgacaccctgagcttcgtcgatgagatccggctggcccagggcagcggcaaagcagaggactaccgggccgaagtccaaaacctggccggctctccagccataaagaaagggatactacagagcctcaaaatcgtagacgagctgatcgaagtaatgggctacgatccagaacacattgttgtagagatggcccgtgagaaccaattcacaaaccaaggccgccgtaactcacaacaacgctacaagaaaatcgagaacgcaatcaaaaacctcgacagcaacctaaactcaaaaatactaaaagaataccccacgaataatcaggcgctacaaaacgaccgcctattcctatactatttgcagaacggcaaagacatgtatacagacgaagaacttgatatagaccaactatctcaatacgacatagaccacataataccgcaagcatttatcaaagatgactcgctcgacaacaaggtacttaccaaaagcgccaaaaaccgcgggaaatcggacgacgttccctccttggagatagtctacaagaagaaaaacttctggcaacaactactagattcgcagctaatcagccaaagaaaattcgacaacctcacgaaagccgaacgtggcggattaaccaacgaagataaagctcgcttcatacagcggcaactcgtggagacccgacaaatcaccaaacacgtcgccagaatcctggacacccgattcaacaccaaactggacgaggccgggaacagaatccgagaccctaaagtgaacataatcatactaaagtcaaacctcgtctcacagttccggaaagactaccaactatacaaagtcagagaaatcaacaattatcaccacgcgcacgacgcgtacctaaacgcggttgtggccactgcactactcaagaaatacccacaactcgcccccgagttcgtatacggagagtacccaacctacaactcatacaacagccgcaagagcgcaaccgaaaaagtcctcttctattccaacatcatgaacttcttcaagagaattgtcgtgcacagtaagaccggcgaagtcaggatccgtccggtaatcgaggtgaacaaggaaaccggcgagatcgtatgggacaaaaagagcaacttcagaaccgtccgtaaggtcctatcttacccgcaagtcaacgtagtaaagaagaccgaagttcaaaaccacggcctcgacaggggcaaacccaagggcttctacaacgcgaacctatccccacgccctaaggaagggtcagtagagaacctagtgcccgcaaaacagagcttcgacacaaagcgatacggcggctacgccggcatttccaacagctacgccgtactggtaaacggcatcatagaaaaaggcaaaaagaaaagcaaggccgaagtcacagagttccaaggaatcagcatcctcgcacgcaaagacttcgacaaaaaccccaagcaatacctactaaacctcggatacaaagatatcaaatccatcataaagctgcccaaatactcccttttcgaactggaaaacggctcgcgccggatgctcgccagcatccttagcaccaacaacaagcgtggagagatacacaaaggcaacgaaatgtacctaccagacaaattcgtcaccctactttatcacgccatgcgcgtaaatcgcaccctcgagcccggacacaagaaatacgtcgaggctcaccgccacgtgttcgacgaactcttgacttacatactagagtacaatgagaaaatcgtcggagcaaaagccaacggcaaacgcatagttgaagcctatagcgctcgaaaagacaccgacaacctcgaagaactttgcaactccttcataaacctgctcaacctcaccgctctggggtcagcagtcgacttcgagttccttggcacgaagatcccccgctacagagactacactccctcgtctctgctaaaagccacgctcatccaccagtcagtcaccggcctctacgaaacgaggatcgacctatccaaattaggaggggactga

SEQ ID NO: 6696 - RNA, 4146 nt, synthetic construct
  misc_feature 1..4146: note = Cas9 variant
  source 1..4146: mol_type = other RNA
atggttaaaaagaaatacgcaataggcatcgacataggaactaactcagtaggatggagtgtcgtgacagacgactacaaagtcccatccaagaaaatgaaagtattcggcaacacagagaaacgctacatcaagaaaaacctgctcgggacactcctatttgacgagggaaacacagcggaaaaccgacgcctcaaacgtaccgcacgacgccgctacacaaggagacgaaaccgaatcctatacctccaagaaatattcgcagaagaaataaataaaatcgacgacagcttcttccaaagacttgacgacagcttcctcatagtcgaggacaaacaaggctcgaaacaccccatcttcggaaccctccaagaggaaaaagagtatcacaaacagtttcccacaatataccacctacgcaaacaactagccgattcctcgcagaaagcggacatccggctgatatacctcgccctcgctcacataatcaaatacagagggcacttcctcttcgaaggcgacttaaagagcgacaacaaagacgtccagcacctcttcaacgagttcgtcgaaatgttcgacaaaacagtcgagggatcatacctaagcgaaaatatacccgacgtcgcggacatccttgtggagaaggtatcaaaatcccgacgactggaaaacgtgctacaatacttccccaacgaaaagaaaaacgggctactcgggaatttcctctcgctcgccctcggcctccaaccaaacttcaaaaccaactttgagctcgcggaggatgccaaaatacaattctccaaagagacatacgaagaggatttggaggaactccttggcaaaatcggagatgactatgcggaccttttcatcgcaacaaagtcactatacgatggtatactactcgcaggcattctctccacaaccgactccacaaccaaagcacccctttcgtctagtatggtgaacaggtacgaggaacaccaaaaagacctggccctactcaaagatttcatacgacaaaacctcagcgattcctacaaagaagtgttcaacgacgcactaaaagacggttacgcaggatacatagaagggaaaaccacacaagaagacttctacaaattcgtaaagaaaaccatcgagaaaatagaagggagcgactatttcatcgacaaaatcgatcgggaagactttttacgcaaacaacggaccttcgacaacggctcaataccacaccagatccatctaaaggagatgcaggctatcataatacgacaggcgaaattctatccctttctggaagaaaaccaagacaaaatagagaagatactcacctttcgtatcccctactacgtaggcccactcgcccgcggcaactcagagttcgcctggctaaaccgaaaaagtgacgagaaaatacgcccttggaacttcgacgaaatcgtcgacaaggaaacgagcgcggaaaacttcatcaccaggatgaccaactacgaccaatacctccccgaccaaaaagtcctacccaaacattcccttctatacgaaaaattcgcagtttataacgaactaactaaggtgcgctacgtcaccgaacaaggaaagagtttcttcttcgatgccaacatgaagcaagaaatattcgacggcgtctttaaagtttaccgaaaagttacaaaagaaaagctaatggacttccttggtaaggagttcgacgagttccgcatcgtagatctgctgggactcgacaaggacaacaagagtttcaacgcatcgcttggaacctaccacgacctcaaaaagatcgtctccaaagacctactggataacccggaaaacgaagacatcctggaaaacgtggttctaaccctaacactcttcgaagacagagagatgatacgcaaacgacttgagaaatacaaagaagtcctcaccgaagaacagcgcaagaaactagaacgccgccactacaccggctggggccgcctttcagccaaactcatcaacggcatccgcgacaaggtaacgcgtaagacaatcctcgactacctaatcgacgacgggaccagcaaccggaacttcatgcagctcatcaatgacgacacattgtccttcgtcgacgaaatccgacttgcacaggggtctggtgaagctgaggactacagggccgaagtccaaaacctcgccgggagccccgctatcaaaaagggcatacttcagtccctaaagatcgtagacgaactgatcgaagtcatgggatacgaacccgaacacatcgttgttgaaatggcacgtgagaaccaatttaccaaccaagggcgcagaaacagccaacaacgatacaagaaaatagagaacgccattaaaaacctcgactcaaacctaaactcaaaaatccttaaagaatacccaaccaataaccaggccctccaaaacgacagactcttcttgtactacttgcaaaacgggaaagacatgtatactgacgaagaactcgacatcgaccaacttagccaatacgatatcgaccacataatcccgcaagccttcatcaaagacgactctctggacaacaaagtgctaaccaaatcagccaaaaaccggggtaaatccgatgacgttccttccctcgaaatcgtatataaaaagaaatccttctggaaacaacttctagacagccaactcatcagccaacgaaaattcgacaatctaacgaaagccgagcgcggaggactcactaatgaagacaaagcacgattcatccaacgccagctagtagagacacgacaaataaccaaacacgtcgctaggatgcttgatacccgcttcaacacaaaattggacgaagcaggcaataggataagggacccaaaagtcaacatcataacgcttaagtcaaacctcgtcagccaatttcgaaaagactaccagctctacaaagtacgcgaaatcaataactaccaccatgcccacgatgcctaccttaacgccgtcgtggccaccgcactcctaaagaaatacccacagctcgcccccgagttcgtatatggagaatatcccacatacaatagttacaacagccgtaaatccgccacggaaaaggtactcttctacagcaacataatgaacttcttcaaacggatcgtggtccacagtaagacaggagaagtcagaatccgcccagtcatcgaagtgaacaaagaaacaggagaaatcgtttgggataaaaagtcagactttcgaaccgtccgcaaggtactaagctacccacaagtcaacgtggtcaagaagaccgaagttcaaaatcacgggttagacaggggcaaacacaaaggtttttacaacgcgaacctaagcccccgacccaaagagggctccgtcgaaaatcttgtgcccgcaaagcagagcttcgacaccaagagatatggcggatatgcgggtataagcaacagctacgcagtgctcgttaacgggatcatagaaaaggggaaaaagaaatcaaaagccgaagtaaccgagttccaaggcatttcaatcctagcccgaaaagactttgacaaaaaccctaaacaataccttctcaacctcgggtacaaagacatcaaatcaataatcaaactcccgaaatactccctcttcgaactcgagaacggatcacgacgcatgctagcctcaatactatccacaaataacaagcgtggcgaaatccacaaaggcaacgaaatgtacctaccagacaagttcgtaaccctattgtaccacgccatgagggtcaaccggaccctcgagcccggacacaagaaatacgtcgagacccacagacacgtcttcgacgagctcctcatctacatactagagtacaacgagaaaatcgtaggagccaaagccaacgggaaaagaatcgtggaagcctactcagcgcggaaagacacagacaacctcgaggaactgtgtaactcattcataaacctgctcaacctgacggccctaggcagcgccgtcgacttcgagttcctaggcacaaaaataccacgatacagagactacacgccctcttccctgctaaaagcaacgctcatccaccaatcggtgacgggactgtatgagacacggatagacctctctaaacttggcggcgactga

SEQ ID NO: 6697 - RNA, 4146 nt, synthetic construct
  misc_feature 1..4146: note = Cas9 variant
  source 1..4146: mol_type = other RNA
atggtcaagaagaaatacgcaattggcatcgacatcggaacaaactccgtagggtggtcagtcgtaacggatgattacaaagtacctagcaagaaaatgaaagtatttggcaatactgagaaaaggtacatcaagaaaaacctcctcggaacactactattcgacgaagggaacaccgcggaaaaccgccggctcaaacgcacagcccgacgccggtacacgcggcgccgaaaccgcatattatacctgcaggaaatcttcgcagaggagattaacaaaatagacgacagcttcttccaacggctggacgacagcttcctaatagtagaagacaaacaaggctctaaacacccgattttcggaactctacaagaagagaaagaataccacaaacagttccccactatataccatctgcgaaaacagctcgcagacagcagccaaaaagccgatatacgactgatatatctagcccttgcacacatcatcaaataccggggacactttctcttcgaaggtgacctcaagagcgagaacaaggacgtgcaacacctctttaacgatttcgtagaaatgttcgacaaaaccgtcgaggggtcctacctctccgaaaacctccccaacgtagctgacgtgttagtcgaaaaagtatcaaaatcgcgccacctcgaaaatatccttcattacttccccaacgagaaaaagaacggcctcttcggaaacttcctcgcgctcgcactcggcctccagccgaacttcaaaacaaacttcgaactggccgaagacgccaagatccaattctcaaaagaaacttacgaggaggacctagaagaactactaggtaaaattggcgacgattacgcggatctattcatcgctacaaagtctctctatgacggcatcctcctagcaggcatactctctacaacgaacagcaccactaaagcacccctgtcctcaagcatggtgaaccggtacgaggagcaccaaaaggacctcgccctcctgaaaaacttcatacaccagaacctaagcgactcctacaaagaagtcttcaacgacaagttgaaagatggatacgccggctacatcgaaggcaagacaacccaagaaaacttctaccgcttcatcaagaaagcaatcgagaaaatcgacgggtcgaactacttcatagagaaaattgaacgggaagatttcctccgcaagcaacgaaccttcgataacggcagcatacctcaccaaatacatctgcaggaaatgcaagcgataatcagacgccaagccaagttttacccattcctcgaagaaaaccaagacaagatcgaaaagatcctcaccttcagaatcccatactacgtcggccccttagcccgaggcaaatctgagttcgcgtggcttaacagaaaatccgacgaaaagatcagaccgtggaacttcgacgaaatggtagacaaagaaacgtccgccaagaacttcatcacccgcatgaccaattatgaccaatacctcccggaccagaaagttctccctaaacactcgctgctttacgaaaagttcgccgtctacaacgaactcaccaaagtgaggtacgtcaccgaacaagggaagtccttcttcttcgatgcaaacatgaaacaagaaatcttcgacggggttttcaaagtgtacagaaaggttactaaagaaaagctcatggacttccttgggaaagagttcgacgaatttcgcatcgtcgacctccttggattggacaaagaaaacaagagcttcaacgcctccctaggaacctaccacgatctcaagaaaatagtctcaaaagacttccttgacaactcagaaaacgaggacatcctagaaaacgtcgtactcacactcactctatttgaagacagagagatgatacgcaaacgcctcgaaaaatacaaagacatcctcactgaagaacagcgcaagaagctcgaacggcgccactacacggggtggggccgcctatcagctaagctgataaacggcattcgtgacaaggtgacacgcaaaacaatccttgactatctgatcgacgatggcacatcgaactgtaacttcatgcagctcataaacgacgacacactatcgttcgtggacgaaatcagactagcacagggatcaggagaagccgaagactaccgagcagaagtccaaaaccttgccggaagccccgccatcaaaaaggggatactgcaatccctgaaaatagtcgacgagctcatcgaagtcatgggctacgatccagaacacatcgtcgtggagatggcccgggaaaaccaattcaccaaccaaggacgcagaaactcacaacaacgctacaagaaaatagaaaacgccatcaaaaaccttgactcgaacctaaactctaaaatcctgaaagaatatcccacaaacaaccaagccctacaaaacgaccgactctttctctactacctccaaaacgggaaagacatgtacacagacgaggaactcgacatcgatcagctttcccaatacgacatagaccacataataccacaagccttcataaaggacgacagcctcgacaacaaagtactcacaaaatctgcgaaaaacagggggaaatctgacgatgtgccatccctggaaatagtctacaagaagaagtccttctggaaacaactacttgatagtcaattaatatcccaacgcaagttcgacaacctcaccaaagccgaacgcggcggcctaacgaacgaggacaaagcccgcttcatccaacgacaactcgtagaaacccgccaaataaccaagcacgtcgcccgcatgctggatacccgcttcaacaccaagctagacgaagccggcaaccggatacgcgacccaaaagtgaacataataaccctgaagtccaacctcgtatcccagttccgcaaagactaccagctctacaaggtccgcgaaataaacaactaccaccacgcccacgacgcatacctaaacgcagtcgtagctacggccctgctaaagaaatacccacaactcgcgcccgagttcgtgtacggagaataccccacctataactcctacaactcccggaaaagcgcgaccgagaaagtactcttctactccaacataatgaatttcttcaaaaggatagtcgttcactccaaaacaggcgaagtgagaatccgcccggtaatcgaggtcaacaaagaaaccggcgagatagtatgggacaagaaatccgacttccgcactgtccggaaagtcctttcctaccctcaagtaaacgtagttaagaaaaccgaggtgcaaaatcacggactcgaccgaggcaaaccaaaaggtttctacaacgcaaacctctcccccagaccgaaagaaggtagcgtagaaaacctcgttcccgcaaaacagtcctttgacaccaaacgctatgggggatacgcaggcatatcaaactcttacgccgtacttgttaacggaataatcgagaaaggcaaaaagaaatccaaagcggaagtcaccgagttccaaggcatctcaatcctagcccgtaaagactttgacaaaaatccgaaacagtacctgctcaatttaggttacaaagacataaaatccatcataaagctcccgaaatattcgctatttgaactcgagaacggctcgcggcgtatgctggcatccattctatccactaacaacaagaggggcgaaatccacaaaggcaacgagatgtacctaccagataaatttgtaactctgctctaccacgccatgcgcgttaaccggacactcgaaccgggccataagaaatacgtcgaaactcacaggcacgtcttcgacgagctcctcatatacatcctagaatacaatgagaaaatcgtaggggcaaaagcaaacggcaaacgcatcgtcgaagcatacagtgcacggaaggacacggacaatctggaagaactctgcaacagtttcataaacctattgaacttaacggcactaggttcggcggttgacttcgaatttctaggcaccaaaattccccgatacagggactacaccccctcctcccttttaaaagccacacttatccaccagagtgtaaccgggctctacgaaacacgtatagacctttccaaacttggaggggattga

SEQ ID NO: 6698 - RNA, 4149 nt, synthetic construct
  misc_feature 1..4149: note = Cas9 variant
  source 1..4149: mol_type = other RNA
atgaagaaaatagtaaactacaatctcggcctcgatattggcactagctcaataggctacgcagccattgacgaccaagggcgcccagtccgtcaccagaacaaaactgtcatgggcgtacgcctcttcaaagaagggaaaacggccgaatcaacgcgtatcttccgaggcacgagacgccgccttagccaccggcactggcgactaggctacctggaccgcatcttcgataatgaaatagccaaagtagacgaaaacttcctcccccggctgaaggcgtccaaacgagcgcgctccgacgaaaaacgctcgttcagaggcagcctcctcttcccagaaaccggagacgacgcttattaccaaaaataccccaccatctaccacctccgatacgcccttatcacgcagaagaagcagttcgatatacgtctcatatacctggccctccatcacatgatcaagtaccgcggcaacttcctcgacacaacacccgtctctgccttcaacattcacgacatcgaccttacagaccagtttgcctcgctcaatgattgctaccagctactcgacatggatttcgaatttcaattcgacctcaacaacatcgagcaagtccagaaactgctactcgacgagacgctaagcaaaacaaaaaggcaagccgccgtcagcaaagtactcgttatgtcaacaggcaacaaagcctttgacgaccaacaaaacgggatcgcaagcgagttcataaaggccctccttgggggccccttcgaccttagtaagatcctcaacctcagcgtcgcggacgtcaagtcgtggaaacttcacatgactgacaaagacgtcgatgacacactcaactccttagtcgaagaactggatgaaaaccacaaacaaattgtaaacctactacagatgatatactcacaagtgatgatgctgggcctattaaacggccaacaatcgatctcagcctcaatgatagaacgctacgacgaccacgcaaagcactgggccgctctcaagaaactactgcccgccctcggcgaacaagaacaaagcaccataatacacgcttacacagcctacaccgggcactcccgcacgaaacaactctcccgagcagagttctacacaaaagtcaactccatcctaaagaaacacgaaaacatcgctgaagcaacagggcttatagaactcatcgacaggaacgagttcatgcccaaacagcgcgacgccgtcaacggcgtcatccctcatcagttacaccaacgtgaactacaactgataatccaaaaccagcaaaaatactaccctttcctcgccgccaaagcctaccccgacgccgatgaaaccatgatcgaacaactgttgagcttccgagtaccctactacgcggggccgctagttgaccgcgacttcataaacgaatcgagtgaccaggaacaagcaatgcaaaacaccaaattctcgtggctcaaaaggcgggaagcgggggaaataaccccctggaacttcgaacaaaaagtcgacgttcaggaaaccgcgaaccgatttataaaacgactcaccaccaaagacacctatctaatgaccgaagacgtcctacccaaagagtcactaatataccagcgcttcgaagtcctaaacgaattaaacgcaataaggataaacgaccgacgcctaactgcggaaaacaaacaactagccttccaacaactgtttatggcgggaaacacgaaaaacgtctcaataaagaaattcagaaactttgtcttcgactccctgaaattcccagaaaaggtcaaaataacaggattcgcaggacagcacaacttcctggcaaagctctcgacgtaccacgacttcaagaagatatttggcgaacgggtcgatcacactgacctccaacctgacttcgaaagaatcgtggaatggtgcaccatatttgaagataggcatatttaccgagagaagctcaaggaaatccaatggctctcccagtccgagatcgaccaattagtactcataaggaaccacggctggggcaggttaagcaagcgacttctcacagggatacgcgactcagacggtagaaccgtcatggatcaactctggttcgggaccgacaacttcatgcgcatcatcagtcagtccgacttcgcggccgccatcgccaacgagaaccgaacccagctcaaccagcacggcctcgaagacgttcttgacagcgcattcatgtccccacagaataagaaagccatccgacaggtattaaaagtcgtcgacgacatcgaacaaactctaggctgtcccccaaagaaagtcatgatagagttcacccgaagtccggacaaaaagaaacagcgaaccgtaacacgtctagaaaaagtccagcaggcttacaaagccgtcgctgatcaactggccggtcaatccatagtttcggaacttgaccaatacgcaaacactcatagcaaactctccgacacatactacctctactttatgcaactcggcagagacctctattcaggtaaaccaatagacatagacagcccaatgcttgacgacgaccacatactcccccgagcattcatgaaagataactcactcgacaacagagctctcacagaaaaacccattaacaatacaaaagcggccaagttccccagcaaggtcttcggacaacaaaaggaggtcacagacttctggaaactgctccgccgctgcgggcttatgtcaaacattaaagaaaaacacctctacctggaccccgacaacgtcgataaatggacccgcagggggttcatccatcgacagctagtagaaacttcacaggtcattaagatcgtcgcgaatattctaaacgaccgataccaacagtcccaaactgaggtactagaagttcccgcacggttaggaactgaactacgcgaatgctttggctggtacaaagtccgcgaagtcaacgactaccaccacgtcttcgacgcatacctcgcagcctttatcggaaactacttatacaggcgctaccccaagctccagccgtatttcgtatacggcaactttgccgaactgaacaaagcccaattaaagaacattaaatcttttaacttcctctacaacataactgacaacaaacgcgtcgtcaaggacattgaaacaggccagaccctctgggacgaccaaatccgccaacaaatccaacacatatacgaatacaagtacatgctcacctcccacgaagccttcacccaacataaagaactgtatgggcaaacgatttacccgagaagagagttcaagcccggcacactaaaggcaataaagcaagaccaacctcaggaactatacggcggatacaaaaacctcaccgcagcctatatgtgcatcgtaaaaatccaggcacgcaagcgccgagccgccgaatatagagtcgtccgcgtcgccaccgaatctctatccgcattgcagcaagccaaacgtctaggcgtacaggcttacgaaagatgcctaaggcaagaactggtacgaaataacgaaatcctgcgcaccaacgccgaccccaactccgctccgcgagagttcgaagtgcttctcgaccgcgtgttatgccaccaaatgattatctcggacggacagaagtacctcctcggctcccacgcctacaaaatcaactgcatgcaactcgtattgagcaacaacagcatgaaaatcctctcaacatcgattgttaaattgaagcagatgacgaacgaaccccttgtacaagtttaccgagaaatcctagacgtcgtcaacaagtacttcacactctacgatgtaaacagtttccgggaaaacttgaaccaattctttgacaagttccgaaccctcccgatcacgaatgaatacgaatcatcgaaaagcggaaagaaattaatccaccgcgggcaactcgaaactctaacgttaatccttcgaggcctccacgccaactccgacaaagttcagtacggagaccaatctacgctcttaggtggattccagacgaaagacggaatcaaactatcaaaagactcagtaatacagtatacatcacccgcaggactcaacgtacgtaccgtaaagctacgagacctagaacagaaagaagctcagaaatga

SEQ ID NO: 6699 - RNA, 4149 nt, synthetic construct
  misc_feature 1..4149: note = Cas9 variant
  source 1..4149: mol_type = other RNA
atggtcgacgaaaagatattctggggattggatatcggcacggattcagtcgggtgggccgtaaccaacagcgaatacaaactcaaaaagtacaagaacaacctgatgtggggtgtccacctatttgacgaagccaaacaatctgccgaacggcggagcttccgaaccgcacgccggcgtctagatcgtcggaagcagaggatcatcctactacaagaatttttcgtcagagccgtctgcgaaaaggatgaaaatttcttccgccggctcaaggaaagcgcccttctacccgaagacgccgagcaccggacaaacaacatcttcttcgacgacccggactacaccgataaagactacttcgaagagtacccaactatacatcacctaatatgcgagctaatggagagtaaggaacctcacgacgtacgactcgtctacctagcgtgtgtctacttgctagcccacagaggtcacttcctgctacccgtcagcgaggacgacatctccaaggtaaccgagttcgagcccctatacgagagcttctacaaagcgctagaagaaaaactagacgatgagcccccattcgatagatcagcagatgattttgcagagatcctgaagtcacacaaaaccgtgagcgccaaaaacaaggacttcgataagctactattcggcggtaaagtcaagacgtatgacaacgaaaacatctcctactcagccctaataaaactcctctctggcgggacggaaaaactcagcaaattcttcgccaatgaggaatacaccgacctcgagaaagattcagtatgcgtgcggaacgcggactttggggacaccctagagatgctagaggggcagatagacgaattagacttcgcattgctcaagagcgtcaagagcctatacgactggtccctactcgtcgacatcctcgagggcaaatcccttatctctgaagctaagaaggacaagtacgacgaacacggctacgacctagacgccttaaagtatctgttccgcgaatacctcaccaaggacgactacaacgagatgttcaaagaggtctctggtaagcaaaattacgcatcctacgtctacaatgcgagcagcgacaaaactcgcgactccaaatacaagaaatgcagccaaaaggacttctgcaaatttaccaaaaagtttctatccaaaatcaaacccaacgaaaaggacaagccatgcctagacaaacttctcgagaaatgcgagcagaactcactctgccccaaacaggtcacaaccgacaaccgcgtaataccctaccaactatactacgtagaactcaaaaagattctggaaaacgcgtgcggctatctgccgtttcttaacgaacgcgacgaatacggcaccgtcgctgacaaaatactaagtatcatgaaattccgcgtaccatactacgtaggccccctcgtcgacagcaagaaatcaccaaacgcatggctcgtccgcaaactcgatggaaagatcactccctggaacttcactgacatggtaaatgaggacgaatcagaaaacgcattcatacgccggatgacatgcaaatgcacgtatgtagctgggcaggacgtcctcccgaagtactcactactatactccaaattcagcgttctaaacgaaatcaataacatcaaactcaacggcgaacccatcagcgtccaaaccaaacaagagatatacaccgaactcttcgaacgaaacaaatcgagggtctcaaagaagaaaatccgcgactgtctgatctcccacggctacgccgcagatagcgacgaggtgacgggcatagacgacatcgccaaatccgccctccgatcttaccacgacttcaagaaaatgctcagcaatggaatactaaccgaacaacaagtagaggaaatcatagagcacatcacagtcaccaccgacaacataagactcaagaaatggctgaaaacacaattccctatgctagccgacgaagacgtaaaatatattaccaaactcaaatacaaagactatggtcgactgtcccgttgcttcctcgaggacgtactaccagtggacaccaaaaccggggaggccgaaagcgacaaaaacataataaccatgctatgggagaccaatgagaacataatgcagctactgtcgagcaaatacagatactccgagaacatcgagcacatgaacagacaatactacgcactcccagaaaaccacaaaagcatgtccgaacggcttaaagacatgtacgtccccactgccgtccgacgcgccgtcacccgaactttcgacatcgtcaaagaactaaagaaaatccagggtcgagatcccgacaaaatattcatagaaatggcccgcggcaccggtgagaccccaaaaggaaaacggaccaactcccgaaaggaccaaatcctcgagcactggcacggactcgataacaaagacatcaacgacctaaagaaatccggcatttgggaacatctggacacgattgacgacgcaaaactccgcagcgataaatacttcttgtacttcatgcaactgggccgctgcatgtacactgaaaaaccgatccccttcgaggaggtagaaaatgagcacaagtggaatatagaccacatatggccccaggccaaaataaaagacgactcactcgacaacaaggtcctagtctcatcaaacgagaacggcaagaaatcggactcctaccccatcagcgatgacatcagacacagcatggccggcctatggcactccctatataagaaaggcctaatatcagaaaagaaataccaacgcctcacacgcagcacgccattcaccgacgacgaactctccggcttcatagcccgccagctggtcgaaacccgccaaagcacgaaagctgtagcaaccctactcaaagaacaattccctaacaccgaaattgtctacgtcaaagccgggctggtctccgacttccgccaagagatgggaatgctcaaatgtcgcgaggtcaacgacctgcaccatgctaaagacgcctatctaaacatcgtcctgggaaacgtatacaacacccgcttcacaaaagacccgctcaatttcgtcaaaaacaacgaaaaatatagcataaagatcttccagaagaacagcgatggaaagaaaactggcgtaatcactcgtaaagtagagcggggaggagaggtcgcctgggatccagagactagcttcgctatcgtccgcaaaatgatgagcaaaaatagcatccgctacgtacgatacgcatacatgaggaaatcgggccaaaacggcggcttcttcgaccaaaacccactgagaaaaggcaagggcatggtatctatcaagcacaatttaagcatcgaaaaatatggcggctatgacaacgcgacaatcagtttctttagcctagtctccataaaagacttcggcgtaatcctgctggcggttgagctgctcagcgcgaacaaattcctcaagaacatatcagaagcgaaggagtacgcagccgataaactatccaaggagctcaacgtcaagatcgtcccgaacgacgtagcattccctctcaacaaccggtacaacgtagtaaagatcaacgcagtcctcgaactggacgggtaccgcgtaatgatagccgccaaacagaacagttcaataaaattcgtctctaacgaaagcctgattctctctagccaacacatggcgtatgtgaaaaagatcacgaagttcatcgagaagcgaaagcaagataaggtgtgcatgatcaacgctttctccggtatctctatcgaagacaatatagaactttacgacgttctcgtatcaaaatgcaacataaagccattcaacatcatgtacgagaacctaggcattaaactttctgacaaccgcgacaacttcataaagaaatccgtcgaaaaccaggtactcatcctatccgagatggtacgcctcttcaaaacagggcggaaagcaggcgtaaacctcgaggaggttggaggaaggaaaaactccggcgtcaaaacactcaacacctgtctatataaggtcaaggactactcaaatatcttcctggtggaccaatcacccacaggactaattgaacacaaatcaccgaacctcctagacctatga

SEQ ID NO: 6700 - RNA, 4155 nt, synthetic construct
  misc_feature 1..4155: note = Cas9 variant
  source 1..4155: mol_type = other RNA
atgaacaaaccgtactcaataggactcgatataggcacgaacagcgtcggttggtccatcatcacggacgactacaaagtccccgccaagaaaatgcgggtgcttggaaacaccgacaaagaatacatcaagaaaaacctaataggcgccctccttttcgacggcggcaacaccgccgcagacagacgcctcaaacgcaccgcccggcgcaggtacaccagacgacgcaatcgcatcctctacctccaagagatattcgctgaagaaatgagcaaggtagatgacagcttcttccaccgcctcgaagacagcttcctcgtcgaagaagacaaaagaggatcaaaataccccatcttcgctaccttacaggaagaaaaggattaccacgagaaattctccacaatctaccatctccgcaaagaactcgcagacaagaaagaaaaagccgatcttcgcctgatctacatagctctagcacacatcatcaaattccgaggtcatttcctaatagaagacgactccttcgacgtacgaaacacagacatctcaaaacaataccaagacttcctagaaatcttcaacacaacgttcgaaaacaacgacctcctctctcaaaatgtcgacgtggaagcaatcctaaccgataaaatctccaaatccgcaaagaaagaccgcatcctagcacaatacccgaaccagaaaagcaccggaatattcgcggaatttctcaaattaatcgtaggaaaccaagcagacttcaagaaatacttcaacctcgaagacaaaacacccctacaattcgcaaaagacagctacgacgaagatctggaaaacctcttaggccaaatcggagacgagttcgccgacctcttctccgcggcaaagaaactctacgactccgtgctactgagcggaattttaacagtcatagacctgtccaccaaagcaccactcagcgcgtcgatgatccaacggtacgacgaacaccgggaagatctaaaacagctaaaacagttcgtcaaagcatcactacctgagaaataccaagaaatatttgccgacagcagcaaagacggctacgcagggtacatcgaaggcaaaacaaaccaagaagccttctacaaatacctaagcaaactccttacgaaacaagaagacagcgagaacttcctagagaaaattaaaaacgaggatttcctacgcaaacagcgaaccttcgacaacggcagcatcccccaccaagtacacttaaccgaactcaaagcaatcattaggcggcaatctgaatactatccgttcctaaaagagaaccaagaccgcatcgagaaaatactgaccttccgcatcccctattacatcggacccctcgctcgcgagaaatccgacttcgcctggatgacacgtaaaacagacgattccatccgaccctggaacttcgaagacctggttgacaaagagaaaagcgcggaagcattcatccacagaatgaccaacaacgatttctacctcccagaggaaaaagtgctccctaaacactctttaatctacgaaaaatttactgtttacaacgaactcacgaaagtccgatacaagaatgagcagggagagacatactttttcgactcgaacataaagcaggaaatctttgacggtgtattcaaagagcacaggaaggtcagcaagaagaaactcctagacttcttagcaaaagaatacgaggaatttcggatcgtagacgtcatcggattggacaaagaaaacaaggccttcaacgcatctctaggtacctaccatgatctcgagaagatactggacaaagactttctggataacccggacaacgaaagcatactggaggacatcgtccagaccttaacccttttcgaagacagggaaatgataaagaagaggcttgaaaattacaaagacctgttcacagaatcccagctcaagaaattatacaggcgacactataccggctggggccggctctcggcaaagctcataaacggcatccgcgacaaggagagccagaaaaccattctcgactatctaatcgacgacggccgatcaaatcgaaacttcatgcaactcatcaacgacgatggacggtcgaaccgaaactttatgcaactcatcaacgatgacggcctatccttcaaatccattataagcaaagcacaagccggctctcatagcgacaatctgaaggaggtcgtaggagagctcgcaggaagccccgcaatcaagaaagggatactgcagagcttaaaaatagtcgacgagctagtaaaagtcatgggatacgaacccgaacaaatagtcgtagaaatggctagggaaaaccaaaccaccaaccagggccgacgcaattcacgccagcgctacaaactgctcgacgacggggtcaaaaacctagcgagcgacttaaatggcaatattttgaaagaatacccgaccgacaatcaagcactccaaaacgaacgactgtttttgtactacttgcaaaatggacgtgacatgtacaccggcgaagcgcttgacatcgacaacctctcacaatatgatatagaccatataatcccgcaagcatttatcaaagacgattccatagacaaccgtgtattagtttcatccgccaaaaaccggggcaaatccgacgacgtcccctccttagaaatagtcaaagactgcaaggtcttctggaagaaactactcgacgcaaaactaatgtcccagcgtaaatatgacaacctaaccaaagcagagcgaggaggccttaccagtgacgacaaagcccgctttattcaacgtcagctagtagagacccgacaaataaccaaacacgtggcacgaatcctggatgagcgcttcaacaacgaactcgacagcaaaggcagacgaatccggaaagtcaagatagtcaccctcaaatcaaacctagtcagcaatttcaggaaagagttcggattctacaagatccgggaggtaaacaactaccaccacgcacacgacgcgtacctcaatgcagtagtagccaaagcaatcctgacgaaatacccacagctagagcctgagtttgtatatggcgattaccctaagtacaactcatataaaacgcgcaaaagcgccacggagaaacttttcttctacagcaacatcatgaacttctttaaaaccaaggtcacactagccgacggaaccgtagtagtcaaggacgacatcgaagtcaacaacgataccggagagatcgtgtgggacaagaagaaacacttcgctaccgtacgtaaagtgctgtcctacccgcaaaataacatagtcaagaaaacggaaatacagacaggtggctttagtaaagaatcaatactcgctcacggtaactcagacaaacttataccgcgaaaaacgaaagacatctatctcgaccccaaaaagtacggcggattcgactcaccgatcgtagcctattcagtcctagtagttgccgacatcaagaaagggaaagcgcaaaagctgaaaacagtcacagaactactagggattacgatcatggaaagatcacggttcgagaaaaacccgagcgccttcctcgaaagcaaaggctacctcaacatccgagctgacaaactgatcatcctccccaaatacagcctgtttgaactagaaaacggcagaaggcgcctcctcgcatccgcaggagagcttcaaaaaggaaacgaactggccctacccacccagttcatgaaattcctctacctagcaagccgatacaacgaatcaaaaggaaagccggaggagatcgagaagaaacaggagttcgtaaaccaacacgtatcctactttgacgacatactccaattaataaacgacttctccaagcgggtcatcctggccgacgcgaacctcgagaaaatcaacaaactctatcaggacaacaaagaaaacattagcgtagacgaactcgcaaacaacatcatcaacctattcacatttacaagcctgggtgcaccggccgcgttcaaattctttgacaagatagtagaccgcaaaagatacacctcaacgaaggaagtattgaactccacactaatccaccagagcatcacaggcctctacgaaacccgaatcgacctcggaaagctcggcgaagactga

SEQ ID NO: 6701 - RNA, 4155 nt, synthetic construct
  misc_feature 1..4155: note = Cas9 variant
  source 1..4155: mol_type = other RNA
atgaagctgagaggcattgaagacgattattccatcggcctcgatatggggaccagctcggtcggatgggcggtcaccgacgaacgaggcacactagcacatttcaagcgaaaacccacctggggcagccgcctcttcagagaagcacaaacagccgcagttgctagaatgccccggggacaacgccgccggtacgtccgccgccgatggcgcttagacctcctccaaaaacttttcgaacaacagatggaacaggccgaccctgacttcttcatccgcctacgacaaagtagactactccgcgacgacagagcggaggaacacgccgactaccggtggccactcttcaacgactgcaagttcaccgaacgagactactaccagcgcttccccacaatataccatgtaagatcatggctcatggaaacagacgaacaagcggacataagactcatctacctagccctccacaacatagtcaaacaccgcggaaatttcctgagggaaggccagagcctaagcgccaaaagcgctcgacctgacgaagccctcaaccatctgcgggagaccctgcgagtatggagctcagaacgtgggttcgagtgctccatcgcagacaatggatccatactcgcgatgctaacacacccagacctctcgcccagcgaccgccgcaaaaagatcgctcccctattcgacgtgaaatcggatgacgccgccgccgacaagaaactgggaatcgccctcgcaggagcagttatcggactaaaaaccgagttcaaaaacatattcggcgattttccgtgtgaagacagttcgatctatctctcaaacgacgaagccgtcgacgccgtaagatccgcctgccccgacgactgcgcagaactattcgatcgtttgtgcgaagtatacagcgcctacgtactccaaggactactgtcgtatgccccggggcaaaccatatccgccaatatggtggaaaagtacaggagatacggagaagatttagccctcctaaagaaactggtcaagatctacgccccagatcaataccggatgtttttcagtggagccacctacccaggtacagggatctatgacgcagcgcaggcccgcggctacacaaaatacaacttagggccaaagaagtcagagtacaaaccatccgaaagcatgcaatacgacgacttccgcaaggccgtagagaaactcttcgcaaaaaccgacgctcgggccgacgaacgctataggatgatgatggaccgattcgacaaacagcaattcctccggaggctcaaaaccagtgacaacggaagcatttaccaccaactacaccttgaggagttaaaggcgatcgtggaaaaccaaggacgattctacccattcctgaaaagagacgcagacaaacttgtcagcctagtctccttcaggattccctattacgtcggaccactaagcacccgtaacgccaggacagatcaacacggagagaacagattcgcgtggtccgaacgaaaaccgggaatgcaagacgaacccatattcccttggaactgggaatccatcattgacagaagcaaaagcgcagagaaattcatattaagaatgaccggcatgtgcacctacctccaacaggaaccggtgctaccgaaaagcagcctgctatacgaagagttctgcgtactcaacgaactgaatggtgcccactggtcaatcgacggagacgacgaacaccgattcgacgccgcagaccgagaaggtataatagaagaactcttcagaagaaagaggaccgtatcctacggcgacgttgcaggatggatggaacgggaaaggaaccaaataggagcgcacgtgtgcgggggacaaggggaaaaaggctttgaatcgaaattaggcagctatatctttttctgcaaagacgtcttcaaagtcgagaggctagaacaaagtgactacccaatgattgaaaggattatcctatggaacacattattcgaagacagaaaaatcctgagccaacggctaaaagaagaatacggtagcaggctcagcgcggaacaaatcaagaccatctgcaagaaacgatttaccggatggggaagactgagtgaaaagttcttaaccggcatcaccgtccaagtcgacgaagacagcgtatcaatcatggacgtgctacgggaaggatgccccgtcagcgggaaaagggggcgagccatggttatgatggaaatcctccgagacgaggaactaggctttcagaaaaaggtagacgacttcaaccgcgccttcttcgccgaaaacgcccaggcactcggcgtcaacgaactgccagggtcacccgccgtccgacgatccctcaaccaaagcatacgaatcgtggacgaaatagcctcaatagccggaaaagccccagcgaacatattcatcgaagtgacgagagacgaagaccccaaaaagaaaggacgccggaccaaaaggcgttataatgacctcaaagacgcgctagaggcctttaaaaaggaagacccagagctctggcgagaactgtgtgaaacagcgcccaacgatatggatgaacgcctgtcactatacttcatgcaacgtggaaagtgcctgtatagtggacgcgcaatcgacatccaccagctctcaaacgccgggatttacgaagtagaccacataatcccgcgcacatacgtcaaagatgactctctagagaacaaggcgctagtatacagagaagaaaaccaacgaaaaactgacatgctcctaattgacccggaaatccgcagacgcatgagcgggtactggcgcatgctacacgaagccaagctaatcggcgacaagaaattccggaacctcctcagatcacggatcgacgacaaggcactcaaaggcttcatagcgcgtcagctagtagagaccggtcaaatggtgaagctagtaaggtcgctccttgaagctcgataccccgaaacaaacataatctccgtaaaagccagcatatcccacgacctgcgaacagccgcggagctcgtaaaatgccgcgaagcgaacgacttccaccacgcccacgacgcatttctggcatgccgcgtcggcctttttatacaaaaacgccacccctgtgtctacgagaaccccatcgggctatcgcaggtagtacgcaactacgtccgacaacaggcagatatcttcaaacgatgccgcacgatacccgggagttcaggattcatcgtaaatagctttatgacatccggcttcgacaaagagaccggagaaatcttcaaagatgactgggacgccgaggccgaggtagaagggatccgccgatccctaaacttcagacaatgcttcatatcacgaatgccgttcgaagaccacggggtattttgggatgcgacaatatatagcccacgcgcgaagaaaaccgcggccctaccactgaaacaagggttaaacccgagccgatatggcagcttctcccgagagcagttcgcctacttcttcatatataaggcgcgcaacccacggaaagagcagactctcttcgaatttgcacaagtccccgtgcgcctaagcgcccaaataagacaagacgaaaatgccctggaacgctacgcaagagaactagcgaaagaccaaggactcgagttcatccgcatagaacgctccaaaattctaaagaaccaattaatcgaaatagacggagatcgcttatgcatcaccgggaaagaagaggtacgcaacgcatgcgagctagccttcgcccaggacgagatgcgcgtcataagaatgctagtatccgaaaaacccgttagccgcgagtgtgtgatatcgttattcaaccggatactcctacacggcgaccaggcgagccgcagactcagcaaacagctcaaactcgcgctcctgtccgaagcgttctccgaagccagcgacaacgtccaacggaatgtcgtcctgggcctgatcgccatattcaacggctccaccaatatggtgaatctaagcgatatcgggggaagcaaattcgcaggaaacgttcgcataaaatacaagaaagaactcgccagtccaaaagtgaacgtacacctcatagaccaaagcgtaacaggaatgtttgaacgcaggaccaaaataggcctctga

SEQ ID NO: 6702 - RNA, 4158 nt, synthetic construct
  misc_feature 1..4158: note = Cas9 variant
  source 1..4158: mol_type = other RNA
atgacaaagccgtacagcatcgggctagacatagggacaaacagcgtaggctgggccgtcatcacggacgactacaaagtaccctccaagaaaatgaaagtccttggcaacacctccaagaaatatataaagaaaaacctgctcggggccctcctgttcgactccggaataaccgccgaaggcagacgcctcaaacgaaccgcccgtcgccgctacacccgccgtcgcaaccgcatcctctatttacaggaaatcttctccacggaaatggcgaccctcgacgacgcctttttccaacggctcgatgacagcttcctagtaccagacgacaaacgagactccaaataccccatattcggcaatcttgtagaagaaaaagtgtaccacgatgagttcccaacaatataccacttacgcaagcatctcgcagactcgtctaagaaagcagaccttcggcttgtctacttggcactcgcgcacatgatcaaatatcgaggccacttcctaatagaaggggatttcaactccaaaaataatgacctccagaaaaacttccaagacttcctcgacacctacaacgccatcttcgaaagcgacctcagcctcgaaaacagtaagcaactcgaagagatcgtaaaagacaaaatctcaaagtcagctaaaaaggaccgcatcctaaaactcttccccggcgagaagaactccggtatcttctcggagttcctaaaactaatcgtgggcaaccaagccgacttcaggaaatacttcaacctcgacgaaaagaccagcctgcaattctccaaagagtcatacgacgaagacctagagaccctgttaggccacataggagacgattactccgacgtatttctcaaagccaagaagctatacgatgccatcctcctgtcgggtatactcacggtaaccgacaacggaacagaagccccgctatcctctgccatgataatgcgatacaaagaacacgaagaagacctcgcactcttgaaggcttacatacgcaatatcagtctggaaacgtacaacgaagtattcaaagacaataccaagaacggctacgccggctacatagacgggaaaaccagtcaggaagacttctacgtataccttaaacgcctcctcgcaggactcgagggtgccgactacttcctcgagaaaatcgacagagaagacttcctccgcaagcagcgcaccttcgacaacggatccatcccttaccaaatataccttcaggaaatgcgggcaatcctcgacaagcaagccaaattctaccccttccttgccaaaaacaaggaacgtatcgagaaaatcctgacattccgaataccatactacgtcggccccctcgcacgaggaaactctgacttcgcgtggtcgataagaaagcggaatgaaaagatcacaccatggaacttcgaagacgtcattgataaggagtcaagcgccgaagcgttcattaaccgcatgaccagcttcgacctctatctccccgaagagaaagtccttcccaaacactcactcctctacgaaaactttactgtttataacgagctaaccaaagtccgatttatagcagaaggcatgcgggactatcaattcttagactccaaacagaagaaagacattgtccggctttacttcaaaggcaaacgtaaagttaccgacaaagacataatagaatacttacacgccatcgacggttatgacggaatagagctaaaggggatcgagaagcagttcaacagctccctttcaacctaccatgacctcttaaacatcatcaacgacaaagagttcctcgacgactcctccaacgaaacgataattgaagagataatccacaccctgaccatgttcgaagatcgcgaaatgatcaaacaacggctctcgaaatttgacaatatattcgataagtcggtccttaaaaagctaagcagacgccactacacaggctggggcaaactcagcgccaaactcatcaacggcatacgggacgagaaatctggcaacactattctagattacctcatcgatgacggagtatctaatagaaacttcatgcagctaatccatgacgacgccctctccttcaaaaagaaaatcaagaaagcccaaataataggtgacaaagacaacataaaacaggtagtcaaaagcctaccaggttcccccgcgatcaagaaaggaatactacaatcaattaaaatcgtggacgagctagttaaagttatgggacgcgaacccgaatctatcgttgtagaaatggcgcgggagaaccaatacaccaatcaaggaaaaagcaactcccaacaacgcctcaaacgcctagaagagtccttaaagggcctaggaagcaaaatcctcaaggaaaacgtccccacacgcctcagcaaaatagacaacaacgctttacagaacgaccggctatacctctattacctccagaatgggaaagacatgtatacaggcgaagaactcgatatcgacagactcagcaactacgacattgaccacatcatcccccaagccttcttaaaagacgacagcatagacaacaaagttctcgtaagcagcgccagtaaccgcggtaaatcagacgacgtaccaagcctcgaagtagtgaagaagcgaaaaaccctatggtaccaactacttaaaagcaagctcatcagccaaagaaagtttgacaacctaaccaaagccgaacgcgggggcctatcccaagaggaaaaggcgggctttatccaacgacaactggtcgaaacacgccagataaccaagcacgtcgcccggctactcgacgagagattcaacaacaagaaggatgaaaacaaccgcacgctcagaacagtcaagataatcaccctcaaatccagcctggtctcccaattccgcaaagacttcgaactatacaaagtgcgggaaataaacgatttccaccatgcacacgacgcctacctcaatgccgtcgtcgccagcgcgcttctaaagaagtatccgaaactagaaccggagttcgtctacggcgactacccaaaatacaactccttccgtgaaaggaaaagcgccaccgaaaaagtgtacttttactcaaatattatgaacatcttcaagaaatccatccccctggcagacggcaccgtcattgaccggcccctcatcgaagtaaacgaagaaaccggagaatcagtatggaataaagtagccgacctcaacaccgtccgtaaagtcctaagttattctcaggtaaacatcgtcaagaaagtcgaggagcaaaaccacgggttggaccgcgggaaacctaaaggcctttttaacgcaaatctatcatccaaaccgaaacccaactccaaggaaaatctcgtcggcgccaaggagtacctagaccccaagaagtacgggggctatgcaggcatctccaacagcttcgcgattcttgtcaagggcaccattgaaaagggcgccaagaagaaaatcacgaacgtgctcgagttccagggaatatctatactcgacagaatctactaccgcaaagataaactaaacttcctactcgaaaaaggctacaaagacatcgaactaatcatagagctccccaaatattcactgtttgagctcagcgacggcagccgaagaatgctcgcctccatcctatccacaaacaataagcgcggagagatacacaaagggaaccagatcttcatatcacagaaattcgtcaaactcctctaccacgccaagcgaatctcatcaacattcaacgaaaatcaccgtaaatacgttgaaaaccataagaaagagttcgaagaactcttctactacatcctagagttcaatgaaaactatgtgggcgctaagaaaaacggcgagctactcaaatccgcattccagtcgtggcagaaccacagtattgacgaactttgttcctccttcatcggacccacgggatcggaacgtaaaggcctgttcgaactaacatcacgaggcggggcagcagacttcgagttcctcggagtgaaaatcccacgctaccgcgactacaccccctcctcccttctcaaggacgcaacactcatacatcaatccgtgaccggcctgtacgaaacgcgcatcgacctcggcaaactcggcgaagactga

SEQ ID NO: 6703 - RNA, 4158 nt, synthetic construct
  misc_feature 1..4158: note = Cas9 variant
  source 1..4158: mol_type = other RNA
atgcaaacatacttcggcatgaagaaaatcctcggcctggacctaggcacaaactctatcggttgggctctggtaaacgaagcgaacgacgacaacgaaaagagctctatcatcaaactcggggttcgagtcaaccctcttacggtcgacgaacaatcaaatttcgaaaagggcaaaagcataaccaccaacgccgaacggaccataaaaaggtcgatccgaagatcactccaacggtacaagctgcgtcgcgaaaacctcatcgaaatactgaaggaacataacttcattaccgacgacacgatactctcagaagatggcaacgcttccacgttcgaaacctaccggctccgagccaaagccgcgtccgagaaaatatccctggaagaactggggcgggtcctactcatgatcaacaagaaaagagggtacaaatccagccgaaaagccaaaaaccaggaggaggggcagctaattgacggcatggaggtcgcaaaggaactatacgagaaaaacatcacacccggacaattcgttttccagctcctcaagcagggcggaaaattcatccccgacttctatcgatcggacctccaggcagagttcgacaagatttgggagttccaaaagctattccacgcagaaatcctcgtggacgacttcaagaagcagctagaacggaagggaaaactgaacagctctaagatcttcctaggacgattcggcatttacactgccgaaaacaagggcaacgacaaacgcctccaagcataccagtggcgagtagacgccctaactaaagaactcacaaaagaagaactagcatacgtaatatccgacctgaacgggataatctccagcagcagcggatacctcgggagcatctctgaccgatccaaagaactctacttcaacaaccagaccgtcgggcaattccttatggcccaactggaccacagcccccacacctccctgaaaaatcaagtcttctacaggcaagactacctcgatgagttcaacaccctctgggaaaaccaagcccactatcacaaggtactaacgagtgacctcaaatccgaaatccgcgacgtaatcattttctaccaaagacgcctcaagacccaaaagggactcatatcgttctgcgagttcgaatcgagaaaaatagaagtagaaatagacggaaagaaaaagataaagaacgtcggatcacgagtgtgtcccaaatcatcacccatattccaagagttcaagatctggcaaattctcaacaacatagagctccttgagaaaagcagcaaagccaaacgcttcctcgaccaggaggagaaagagctactcttcaaagaactatccataaagtccaagatatccaaatcggacgcgctcaaactgctgttcaaaaacagccgcgaactcgacctaaactacaaagaaatcgaagggaaccgaacccagagcgccctcttcgacgcgtattcaaaaataatcgagctatccggccacggagaatacgacttctccaaaatggaggccagcaacataatcgagctagtacaagaagtcttcaccgggctaaactacaacacagagatactctacttcgactcgagtctcgaagggaaagacttcgaaaaccaacccatgtatcgcctatggcatctactatatagcttcgaaggagacgactccaaaacaggcaatgaaaagctcatcaacaaattatcagaactatacgggttcgaaaagaagtactcgattgtcctagccaacgtgtccttccaagaagattacggatcattatcgaccaaggccatacgaaaaatccacccctacctaaaggagggcattcaatacgacgttgcctgcgaatttgccggttaccggcactcaaaatcttcgctaacgaaagaagaaatcgaaaacaaaatactcaaagaccaactcgagatactccccaaaaactcacttcggaacccagtggtagagaagatactcaaccaaatgatcaacgtagtaaacgcgctcaatgagtcctacggcaagcctgacgagatacgcatagaactcgcacgagagctaaagaaaagcgcaaaagagagggaggaactgacagcctccataggagaaaccacaataaagcacgaaaaatatcgggcaatactagaaaatgagttcgggatctcgcacgtaagcagaaacgacataatccgctacaagctgtacctcgaactagaaaatcgcggctataagacgttatatagcaacacctacgtgagccaagaaaagctgttctcaaaagaatttgacatcgaccacatcatcccgcaaagctgcctgttcgacgactcgttttcgaacaaaaccctcgaatcgaagtcagtaaacatcgaaaagggaaacgacaccgcgttcgactacgtgttcgcgaaatacggagaagcgggactctctgactacatcattcacatcgaggaactgtttaaggacggcaagatatcgaagacaaaactcaataagctcaagatgaaaggcaacgaaataccatcagacttcattgcgcgcgacattcgcgacacccagtatatagcacgtatcgcaaagaacatcctcgaagaaaccgtcaggaacgtggtctccacttccggaagcataactgacagactacgcgaggactggcaactcatcgacgtaatgcaggagctaaactgggagaaatactccgccctgggcctgacagaaatatatgagaatagagagggacacacaattcgccgaattaaagactggacaaaacgtaacgatcaccgccaccacgccatggatgccctcaccatcgccttcaccaaacgatcccacatacaatacctcaacaacctgaacgcacggtcagacaagtccggctcaatctacgggatcgaaaccaaggagctatatagggacgaccacggtaaactgaaattcaaacccccaataccgctgaacgagttccgagctgaagccaaaaagcacctagagaacacgctaatatcaatcaaagcgaaaaacaaggtggccaccatcaacatcaacaccacatcaacaaaggaaggcaagaacaagaaacgacaactaaccccacgaggccaacttcaccttgaaaccatatacggtagcatccaacaatacgtcaccaaacaagaaaaagttggggcctcatttaacgaagaacaaatcagcaaagtcgccaaacaaaaatacaggcaagccctgctaaacagactccgcgagttcgacaacgacccaaagaaagcgttcacgggaaacaacagtttcgagaaaaaccccatatacctcgacgtacttcagacccagaaagtgcccgataaagtggagaccgttagcaaagagatcatatacacgatacgaaaagacatcaccccagaactcaagatagaaaaggttatcgacaaaaagatcaagacaatactgcaatcccgactgaacgagtactctggcgactccaaaagagccttctccaacctcaaagagaaccccatctggctcaaccaagaaaaagggatagaaataaagcgggtcaccatctcaggcatctcaaacgcggtagcaatccacgacaagaaagacaaaaacggcaacctcatcttggataacgaagggtctacgcaggcagtagacttcgtaaacaccggcaacaaccaccatgtagctatctacaaagacgagcgcggcaacctccacgaatccgtagtctccttctttgaagcatgcacccgcgtcaatctcggaggacccgtaatcttcaaaaactacaacaagtccgacgggtgggagttcctgttctcgatgaagcaaaacgaatacttcgtattccccaacgagaaaacaggcttcaacccaaacgaaatagatctcctcgacccggacaactacagactaatcagccccaatttattccgtgtacagaaaatatccagcaagaactacgtgttcaaccaccatctagaaacatcagcaatcaccggagaaacgctcaaaaataagaaacaactttcctccgtaacctaccacttcattcaaagcctacccccaatcaaagacatcgtaaaagtccggataaacaacataggacaaatcgtgtgggtaggagaatattga

SEQ ID NO: 6704 - RNA, 4158 nt, synthetic construct
  misc_feature 1..4158: note = Cas9 variant
  source 1..4158: mol_type = other RNA
atggacgaactccaaaactttgaaaaagggaaatcgatcacaaccaacgcggaccgcacagcgggtcggagcatgagacggaacctacagcggtacaaactcagaagagaaaacctcatcgaagtcctcaaagagtacaacttcatcaccgacgaaatgatattatccgaaaacggtaatcggactacattcgagacataccgccttcgagccaaggccgcggtcgaggaaatctcactcgagcaattcgcaagggtcctgctgatgatcaacaagaagcgggggtacaaaagctctcgcaaagcgaaaggcgccgaaaatggaaccctaattgacggaatggaagtagcaaagaaaatgtatgacgaaggcataaccccaggggaactttgcctacagctcctcacagccggaaaacggtacttcccagacttttacagaagcgacctacaggccgagttcgaccgaatatggaacttccagaaacaattctatcccgactccctaatagacaaggtgaaggacgaagtacgcggcaaaaataagtctcagacatgggcaattttggccaagtactttgtctggaaagaagtcgaaaactcatggaacgaagaagaagcccagacacgccgagtcgaaaaagagtaccgtctagtcggaataaagagaggagtcaagcgggaagaactcaaactcgagaacttccaatggcgggttaaagccctatcagaacgcatgaaccccgaagaactagcaatcgtactacaagaaataaatgaacagatctcaaattcgagcggatacctaggcgccatatccgaccgcagcaaggagctctactttaaccgccagaccgtaggacaataccaaatggcggtgctagacaacaacccaaacataggcttgcgaaacatggtattctaccgccaggggtatctgggcgagttcaataccatctgggagaagcaagcagagttccacaaagagctaaccgaggatcttaagaaagagatacgggacatcgtcatattctatcaaaggcgattaaaatcccagaagggccttatcaacatctgcgagttcgaaagacgacaaattgaagtggaaatcgacggcaaaaagaagatcaagaccattggatcccgagtcatcccccgaagctcgccactcttccaggagttcaaaatctggcagacccttaacgacatcgaagtatccgtactcggcgtaaagaacaaacggaagaagcaggacgacaactcaacaacgctactcgactcggcagaaaacatagacagcctaaaactcaacgtaagcaggcccctcgacgcggatgagaaaagccttttggctaaagaactatttatcagagataaactaacaaaatccgacgtcctcaaactactgttcaacaacccccaaaacctaaacctgaacttcaagaacatcgacggaaaccgcaccggctcagccctataccaggcattctccaaaatactagaaatatccggacacgaaagcataaactttaagaaatccgcagacgaaatagtagaacaagtcaaaaccatcttctcagccctggggtggaacacagaagtgctctgcttcgacagcgaaaaagaactggacaaacaaccgtacttcaaactatggcacctcctatactcgttcgagggggattccacacctacgggagacggaaacctaattcagaaaatcgcagacctgtgcggcttcgagaaggactacgccagcatcttagcgaacataacattccaagaagactacggcagcctctcaaccaaagcaatacggaaaatactcccacacctcaaagacgggaatcaatacgacgtcgcctgcgaatatgcgggctacaaacattccaaatcctccctcaagaaagaggaaatcaaaaacaaagtattgaaagataaactcgaactactccccaagaactcgctccgcaatcccgtagtggagaagatcctcaatcaaatggtcaatgtaataaacgcaatcataaccacgtacggcaaaccagacgaaatccggatcgaactcgctcgcgaactgaaaaagaaagccaagaaacgagaagaactcaccaaaacaattgtggacacaacaaaaacgcacgaaggcatacgagcaatcctgcaaaacgacttcggcatgtcccatgtcagcagaaatgccatcatacgatataaactctacgaggagctcaaagacaacggttacaaaacgctttacagcaacacctacatccccaaagaaaaactcttcagcaaagacttcgacattgaacacattatcccgcaagcgcgactattcgacgacagcttctccaacaagaccctggaagtaaagagcataaacatcgagaaaggctccaagacagcatacgacttcgtagaagagaaatatggggagcaaggtctacaagagtatctcaacagatgcgaagttctattccgagacaaaaagaccaaactgcgtaaactgaaaatgcaagaatccgaaatccccgagggattcatcgaccgtgaccttcgaaacacacaatacatcgccaagaaagccctcagcatgctcaacgaaatatgccgcagggttgtggccaccaccggagccataaccgacgaattacgcgaggactggcaattagtggacgtcatgaaagaactcaactgggaaaaatataaagtactcggcctagtagagtacttcgaagacaatgacggacgcctcatagggcgcatcaaagactggacgaaacgcaacgaccaccgtcaccacgccatggacgcattaaccgtagcgttcacgaaagacgtcttcatccagtacttcaacaacaaaaacgcaagcctaaagcccgacaccaacgaggccgctatacgcaacaaatacttccaaaacggcaaggcaatcccaccgatgagcctggacgagttccgagccgaggccaagaaacacctgaacgacaccctgataagcataaagacaaagaacaaagtagtaaccatcaatcttaaccggaccaaaaagaaaaacggaatcaacaagaaacagcaacaaacgccccgcggacaactacacctggaaaccgtctacggatctcacaaacaatacgtcgtcaaagaggaaaaagtaaacgcatccttcgacgcggcaaaaatcgccaccgtcaacaaaccagcgtaccgtgacgccctcctccgcagactgcaagagaacggcaacgattcgaagaaagcattcaccggcaaaaacagtctagacaagcagcccgtctggctggacgccaaacagaacgaatgtgtccccgaaaaggtgaaaaccgtcatgctagaaacggtctataccgtccggaagcccatagacgagaagctcaacgtcgacaaagtcgtagacgcaaggatacgaaagctactacaagacagaataaaggaatacggaaacgccaaatccgcgttcgccaaccttgacgagaacccaatatggctcaacaaagaaaaaggcatcaccatcaaacgcgtctccgtctccggcatatcaaaggcccagagcctacacgaaaagaaagacaaagacggcaacttcatcctggacaaagactcccgacgcataccagtagacttcgtaaacacgggaaacaaccaccacgtcgctatatacagaaagcccgtactcgataagaaaggccaggccgtattcgacgaaaacggcgaattaaaatttgagctcgaagaggtcgtcgtttcctttttcgatgccgtcacccgcgttaacctctcacagccaataatagacaaagactataagcgatcggaaggctggaagttcttattctcaatgaaacagaacgaatacttcgtattccccaacgaaaagacaggcttcgaccccaaagagatagacctactcaatccggagaactacgccctcatatcccccaacctcttccgcgtacagaaaatcgccagcaaagactacgtgttcagacaccacctagagaccgtcgtcgccgacagaaaagaactgcaagaaataacttggaaacggatctcatcattatctatcctcaacagaatcataaaggtcagggtgaaccatattggccagatagtaatgatcggtgagtactga

SEQ ID NO: 6705 - RNA, 4158 nt, synthetic construct
  misc_feature 1..4158: note = Cas9 variant
  source 1..4158: mol_type = other RNA
atgactaaaccatatagcataggcctcgatatcggaactaacagcgttggatgggcagttatcacggatgactataaagtcccctcaaagaaaatgaaagttctcggcaacacatccaagaaatatataaagaaaaacctactcggagctctgctctttgacagcggaataaccgccgaagggcgaaggctgaaaagaaccgccaggcgcagatatacgcgccgtcgcaatcgaatcctctaccttcaagaaatcttctccactgaaatggccacactagatgacgcattcttccagcgcctagacgacagcttcctagtccccgacgacaaacgggactccaaataccctatcttcggcaacctcgtcgaggaaaaggcttaccacgacgaatttcctaccatataccacctacgaaaatacctagctgactccaccaagaaagcagacttaagacttgtctatctagccctggcccatatgatcaaataccgaggccacttcctgatagaaggcgagttcaacagcaaaaacaatgacattcaaaagaacttccaagatttcctggacacctacaacgccatcttcgagtcggacctatcgctagagaactcaaagcaacttgaggaaatcgtaaaagacaaaatctcaaaatccgcgaagaaagaccggattctcaaactattcccgggagagaaaaattcgggcattttctccgagttcctgaaattaatagtaggaaaccaggccgatttcaagaaatacttcaacctcgacgaaaaagccccactccactttagcaaagaatcctatgacgaggacctagaaacgctcctcggatacataggagacgactactcggacgtatttttaaaagccaagaaactatacgacgcgatactgctcagcggaatactcacagtaacggacaacggcacagaagctcccctctcctcagccatgatcatgcgctacaaggagcacgaggaggacctagcgctgctcaaggcatacatacgaaacataagcctagaaacatacaacgaggtctttaaagacgacaccaagaatggatatgccggctacatcgacggcaagaccagccaggaagacttctacgtacacctcaagaaacttctcgtcggcctcgaaggcgcagactactttctagagaaaatcgacagagaagatttcctccgtaaacagcgtaccttcgacaacggcagcatcccgtaccaaattcacctacaggaaatgcgagcaatactggacaaacaggccaagttctacccattcctggccaaaaacaaggaaagaatagagaaaatactcaccttcagaatcccatactacgtcgggccattagcacgaggcaattcggacttcgcatggtccattaggaagcggaacgagaaaatcaccccctggaacttcgaagacgtcatcgacaaggaatcatcagccgaagcattcattaaccgaatgacctcattcgacctctatcttcccgaagaaaaggtcctcccaaaacactcactactatacgaaaccttcaatgtctacaacgagctcacaaaagtccgattcatagcggaatctatgcgcgattatcaattccttgacagcaagcagaagaaagacatagtgcgcctctatttcaaaaacaaacgcagagtaaccgacaaagacatcattgaatacctccacgccatcgacggctacgacggtatcgaactcaagggcatcgagaagcagttcaacagttccctcagcacctaccacgacctactcaacatcataaacgacaaagagttcctagacgactcaagtaacgaagccataatagaagagatcattcacacccttaccatcttcgaggaccgcgagatgatcaagcaacgactatccaaattcgaaaacatcttcgacaagtccgtcctcaaaaagttatcacgacgtcactacacaggctgggggaaactaagcgccaaactcatcaacggcatccgagacgaaaagagtggcaacaccatcctagactacctcatcgacgacggggtctccaaccgcaacttcatgcagctcatccacgacgacgcactctccttcaaaaagaaaatcaagaaagcccaaataatcggcgacaaagacaacataaaacaggtcgtgcaagccttacctggcaggccagccatcaaaaagggaatactgcaaagcattaaaatcgtcgacgagctagttaaggtcatggggcgccgacctgaaagcattgtcgtcgagatggcccgggaaaaccagtacacaaaccaaggaaaaagcaactcgcagcaacgtctaaagcgcctggaagagagcctcaaagaactcggcagcaaaatcctgaaagaaaacatcccagccaaactaagcaaaatcgacaacaatgccctacagaatgacagactctacctatactacttgcagaatgggaaagatatgtacacaggagaagaacttgacatcgatcgactatcaaactacgacatcgaccacatcataccacaagcattcctaaaggacaactcaatcgacaacaaggtcctcgtatcatcagcaagtaaccgcggaaaatcagacgacgtcccttcactagaagtagtaaagaaaaggaaaaccctctggtaccaactccttaaaagcaaactaatatcgcaacgaaaattcgataacctaacgaaagcagaacgaggaggcctctcaccagaagcgaaggccggatttatacaacggcagctcgtcgaaaccaggcaaatcaccaaacacgtcgcccgccttctagacgagcgattcaacaacaagaaagacgaagacaacaaaacactgcgaaccgtaaaaatcatcacactaaaaagctcactcgtatcccaattccgaaaagacttcgagctctataaagtgcgagagatcaatgacttccaccatgcacacgacgcctacctaaacgccgtagtcgcatcggcactcctgaagaaatacccgaaactcgaacccgagttcgtttacggggactacccaaaatacaactccttccgggagagaaaatccgcaaccgaaaaagtctacttctactcaaacataatgaacatcttcaagaaatccatttccctggccgacggaactgtgatcgaacgaccactgatagaagtcaacgaggagaccggagaatccgtttggaacaaagtagcagacctcaacaccgtccggaaagtcctaagctactcccaagtgaacatcgttaagaaagtcgaggaacagaaccacggccttgacagaggaaaaccgaaaggcctcttcaacgcgaacctaagctccaaacccaaaccgaactcgaaagagaacctcgtgggggcaaaagagtacctggaccccaagaaatacggaggatacgctggcatttccaacagctttgccgttctcgtgaaaggcacaatagaaaaaggtgcgaaaaagaaaatcacaaacatccttgaatttcaaggtataagcattctggaccggataacctaccgcaaagacaaatttaactttctcctagagaaaggatacaaagacatcgatctcataatagagctacccaaatattctctgttcgagctcagcgacggctcaaggcgcatgctcgcttcaatcctctccacaaacaacaaacgaggggaaatccacaaaggaaaccaaatcttcattagccaaaaatacgtaaaactcctataccacgccaagaggatctccaacacgttcaacgacaaccatcgcaagtacgttgaaaaccacaagaaagagttcgaggaactgttctactacatactcgagttcaacgaaaactatgtcggcgcaaagaaaaacggcgaattgctaaaaagcgcgttccaaagctggcaaaaccacagcattgatgaattgtgctccagcttcatcggccccacagggagcgaaagaaaaggtctattcgaactcacctcgcgcggaggtgcggcggacttcgacttcttaggtgttaaaatcccccgctaccgggactacactcccagctcactcctaaaagacgcaacactgatacaccaatccgtaacaggcctgtacgaaactcgcatagacctcgggaaactcggagaagactga

SEQ ID NO: 6706 - RNA, 4158 nt, synthetic construct
  misc_feature 1..4158: note = Cas9 variant
  source 1..4158: mol_type = other RNA
atgaaaaacaaaacatggtatcttggactcggcgttggcccaacatcaatcggctgggctgccaccgactccaactacaaattgctgcgtaaaaacaagaaacggttgtggggagtcagactcttcgaagaggcaaagactgccgtcgaccgacgaacatttcgcgccgaacgccgacggctggcccgaagaaaatggcgaatcagcttattagaagaactattcgcgaaagaggtctccaaaaacgacccaaacttcttcctccgccttaaggagtcaaaataccacttcgaggacaagtcattgatgaacgagtacatactattcaacgacaaagactacacagacaaggactattacaaagagtaccccaccatataccatctacgcctcagtctaacgaccgaggagaatccagacatccgtaaagtctacctagcggttcacagcatgctcaaaaaccgcggacacttcctactacaaggacagagcttcaacgacagcaacatcgactcggtcatcaaggaactccttgagctcgagaccgtcaaaataaacttcgaagtaacagacgaggtaatacacagtctgaaaaagatcgctctggagaaaaagaacctttccgacaagaacaatgatgtaaagaagctatacccaaaagaaaaacaactgcaggaaatcttcaagctagtcttcgggggaaagaccagcctcgacaaactatacgacatcgaagaatacaaggaactcgacaactcagtaaagtccatatccttcaaggaaaaagtatacgaagaagtccgcccagactacgaacaaatcctctccaattacatagagctcctggatctcgccaaacttgtttacgatagcatcgtactggccgacataaagaaagaagggaagaccataagtgaaagtaaggtcgagctctataataagcacaaagacgacctcgcgaacctaaagaaattagtaaaaatcgactccaaactatccgaagacaaaaagaaggaagtctacttcacgatattcaaagaagacaaagagaaaggaacaaactacgtgaactacacccaccgctcccaggaaggaaagagctgctcatacgaagactttaagaagttcctcaaaaaggagctcgagaaattagaggatagcccaaccaaaaccaccattctggaggaactcgacctcgagactttcctccccctacaaagaacaaaagataactcagtggtcccataccaaatacacaaggaagaactcgtgaagattctagacaacgccgccaaataccattcattccttgctgagaaagacgacagcggttactcaacacgcgaaaaagtggtccagctattcgagttcagaatcccctattacatcggacccctcaacgcacaccacaacaccgagaacgggggctactcctgggcaatcagaaagaaaggaatggagtccgtgcccgtcacgccgtggaacttcaaagacgtcatagacgagagcgcgtcagccgaagccttcgtaaataacctcaaaaataagtgcgcttacctgtccggagaggacgtcctgcccaagaactctctgctatactcagaatacgctctgctcaatgaacttaacgccctccgatacgaaggtaaccgtataagcgtcgaagcgcgagacgtcatagtcaccaaactattcaaagaacaaggcaaaaaggtcaccaagaagacgataaaagagctcctcaagaccgaagggttcatagacggcaaaggagaaatcgttggcatagacaacatcgtgaaaaacgacctaaaaagctacagggacttcaagaagatactcgctgacaaattcgacaaagaaagagtcgagaacattatactgtggataacgctctatggggaatcccgcaagctgatcaaggagaaaatcaccaaagtgtacggcgacttctacacagtcgacgagatagagaagatgtctaggcttacatataaggactgggggatactctcccgaaagctgcttacggagctagtctccgaaaagctatacaacgaagaaaccggcgaatgcctcaacattatcggcgcgatgcgacaaggcaccatcctgttcatggaactgctcgctgacaagtttgattatatgagccaaatcaaaaaccacaacaaggaaaacaaggacgacataacagaaatcacgccggacatccttgagaacctgcacgcgagtcctgctgtcaaacgctcaatctggcagacagtccgcattgtagaggaactaaaaaccataataggctgtgtcccgaccaagatcttcatcgaaaccacgaagcggaacaatgcaccctataaagttccgaccctaaaccgaaacgacctcgtcaccaagtacaaaacgataagggaacacgaaatcttcgagctcgaaaaagagcttaaaaataccctagatttcaccctaaataaaaaccggctcataaacgaggagccatcaaagctcaaagctacgaaactctacctatactacacacagctcggacgctgtatgtacacgggtaagaaaatcgatttaggagaactctttgacaacaacaacaagtacgacatagaccacatctacccacaatccaaagtgaaggacgggtcctttaacaatatagtcctagtaaccaaggcgagcaacgacatgaaagccgacgtgttcccacttaagtcaaaatttcagaccaaggaaaacaagatcttctggaggttcctcaaagaaaagaaactcatcacagaagaaaaatataacaggctagtcagaaccgaagagttctcgaacggggaactcacggggttcatcacccggcaactcgtcgaaacatcgcaagccataaaagtcatcagcaacgtcctccgagagttgaaccccgaaaccaccatctgctacagcaaggcagagaacgtctcatccttccgccagagtttcggcaaaataaaagaagcgaaccgcaaagcggaaaacaacgaaaaactaatccgggtacaggaaattaatgattactacaacgcaaaagacgcctacctttccatcgtggtagggaacgtctacgacgtcaaattcacgcgaaacgtccataacttcatcaaaaacaacaaagacgccagacggtacagcctgaacggcctattttacaccgacgtgaagaacgcaaacactatagcctgggaaatggacaaaaccgttcacgtagtcgaaaagaccatgaacaacaacaacatactgataacccgtcgaacatccgagcaaaaaggagcactctatgacgcaacactgtacaaagccaaagtcgccgagaaagccaaggaaggaacttactacccattaaaaacaacggactctaaaataaaagacgtggggaaatacggcgggttcacaaaaatcaaaatcgcgtactactccatcttcgagtacaccctcgatggtaaaaagggaaagcagaaaataacacgcatcgtacccatcccgatctacataagccaaaacataaaagacgacaaggccctccttgaatacgcgcagactcggctcccggggaaagacctaaaaataaagtaccgcaaactctgcatcgggagcctagtcaaaatcaacaacttcaactactacatagggggaaaaacaaacaacaacttcaccttcgactcagccgtccaagttatattggataaggactcagaatcgtacatcaaggagcttgcgaaatacctgaattggaagaaagaaaacaaagatggaaagctgtgggaaagcataaccgaagacaaaaacatccaactctacgactcattagtcaaaaagatgaacaccggcatattcattcgcaagaccccgaacaagtacacagaactcctcaccctcgaagtaaagaacaagttcataaacatcgacatagacgagcaagtaaaactcctgctggaaatactgaacctcctcaccaataagaaattcaccagcaaactaaacgagatcggcatcaccgcatccaggggcgtatgcagcttcaacctttctaatcagtcgcagttctccatcatcgaacaaagcgtaacaggcgtatatgagaaagaaaagctcataatcgagaagaaaaaggagggaatcctgtga

SEQ ID NO: 6707 - RNA, 4161 nt, synthetic construct
  misc_feature 1..4161: note = Cas9 variant
  source 1..4161: mol_type = other RNA
atgaaccagaaatacagcatcggactagacatcggcactaactccgtgggttgggctgtcataaccgacgactacaaggtgccagccaagaagatgaaagtactgggcaacacagacaagcaatcaatcaagaaaaatttgctgggcgcactcttgttcgacagtggagagacggccgaagcaactagactaaaaagaactgcacgcagacgatacactagacgccggaaccgcctccgttacctgcaggaaatcttcgcagaagagatgatgcaagttgacgagagcttctttcaacgacttgacgattcgttcctcgttgacgaagacaaacgaggcgagcggcaccccatcttcggcaacatcgcggccgaagtcaaataccacgacgagtttcccaccatatatcacctccgtaagcacctcgctgacatttctcagaaagccgacctccgactcgtttacctcgctctcgcgcacatgataaaattccgggggcatttcttgatcgagggccagctcaaggccgaaaacacaaacgttcaagcactttttaaagacttcgtcgaagtatacgacaagacagttgaggagagccatctatcggaaatcaccgtagacgcgctatctatactaactgaaaaagtctccaaatcccgacgcctagaaaacctcatagcacactaccctgccgaaaagaaaaacacactctttggcaacctgatagcactattcctaggactacagccaaacttcaaaaccaatttccaactcagcgaggatgccaaactccagtttagtaaagacacatacgaagaggacctcgaaggactactcggagaggtcggcgacgaatacgcggacctcttcgccagcgccaaaaacctgtacgacgccatactcctaagcggcatcctaactgtagacgacaattccacaaaggcacccctctcggcctcgatggtaaaacgatacgaagaacaccagaaggacctcaagaagttcgaggacttcataaaggtaaacgccctggatcaatacaacgccatcttcaaagacaagaacaagaaagggtacgcaggttacatcgagagcggcgtcaaacaagacgagttctacaaatatctaaaaggcatactcctgcaaatcaacggctcaggcgatttcctagacaaaatcgacagagaagacttcctaagaaaacagcgaacgttcgacaacggctccatcccgcaccaaatccatctacaagaaatgcatgcaatcctccgccgacagggcgagcactaccccttcctcaaagaaaatcaggacaagatcgagaaaatactaacatttaggataccgtactatgtgggaccattggcccgcaaaggcagccgcttcgcctgggccgaatacaaggcggatgaaaagatcaccccctggaacttcgacgacatactagataaggagaaatcagcagaaaaattcataaccaggatgacactcaacgacctgtatctgcctgaagaaaaggtgttgccgaaacactctctcctctacgaaacattcaccgtttacaacgaactaacaaaagtcaaatacgtaaatgaacaaggcgaagccaaattctttgacgccaacatgaaacaggaaattttcgaccatgtgttcaaggaaaaccgaaaagtaacgaaagacaaactccttaattacctaaataaagagttcgaagagttccgcattgtcaaccttacagggctggacaaggaaaacaaggtcttcaactcttctctggggacctaccacgacctgagaaagatattgaacaaatccttcctcgacaataaagaaaacgcgcaaataatcgaagacatcatacaaaccctgacactcttcgaagaccgcgaaatgattcgccaaaggctacagaaatactcagacatctttaccaaggcccaactcaagaaactcgaacgccggcattacacaggatggggccgcctctcctacaaactaatcaacgggatccgaaacaaagaaaacaagaaaaccatcctcgactacctcatcgacgacgggtatgcaaatcgcaacttcatgcaactgatcaacgacgacgcattatccttcaaagaagagatcgccaaagcccaaattatcggcgacgtagacgacatcgccaacgtagtacatgatctcccaggaagccccgccatcaaaaagggtatattacaatctgtcaagatagttgacgaactggtaaaagtcatgggacacaaccccgctaacataatcatagaaatggcacgagaaaatcaaacaacggaccgaggacgccggaactcccaacaacgccttaaactgctccaagactccctgaaaaacctggacaaccctgtaaacatcaaaaacgtggaaaaccaacagctacagaacgaccgcctattcttatactacatacaaaacggcaaggacatgtatacgggagagaccctcgacataaacaatctgtcacaatatgatatcgaccacataatcccccaggcctatatcaaagacgacagcttcgacaaccgcgtcctgacaagcagttccgaaaaccgaggaaagagcgacaacgtcccctccatcgaagtagtgtgcgcgagaaaggcagactggatgaggctgcgaaaagcggggctcatctcacaaaggaaattcgataatttaacaaaagcagaacgcggtggcctaaccgaaaacgataaagccggcttcatcaaacggcagttggtagaaaccagacaaataaccaagcacgtagcccaagtcctagacgcccgattcaacgctaaacatgacgagaacaaaaaggttatcagagacgtcaaaatcatcaccctcaaatccaacctcgtctcccagttccgcaaagacttcaaattctacaaagtccgcgaaatcaacgactaccaccacgcccacgacgcctacctgaacgccgtcatcggaaccgcactcctcaaaaagtacccgaaactcgcctcagagttcgtctacggggagttcaagaaatacgacgtacgaaagtttatagcaaaatcagataaagaaataggtaaagccactgccaaatacttcttctattcgaaccttatgaacttcttcaagaaggaagtaaaatttgccgacgggactgtcgtagaaaggccagacattgaaacctcagaagacggagaaatcgcctggaacaagcagaccgacttcaaaatcgtgcgcaaggtgctaagctacccccaggtgaatatagtcaagaaaaccgaagtccaaacgcacgggctagaccgcggaaaaccccgaggactcttcaacgccaatccaagcccaaagcccaaaccagacagctccgagaacctcgtcggagtcaaacggaatctggaccccaagaaatacggtggatacgctgggataagcaactcatatgccgtgcttgtaaaagcaatcatcgaaaaaggagtcaaaaagaaagagaccatggtacttgagttccaaggcatctcgatcttagaccgcataacattcgaaaaagacaagagggccttccttttaggtaaaggatacaaggacatcaagaaaatcatcgaactacccaaatactccctcttcgaactaaaagacggttcgcgccgcatgcttgcctccatccttagcactaacaacaaacggggagaaatacacaaaggaaacgaactcttcgtaccccaaaaatttacgaccctcctgtaccacgccaaaagaatcaacaacccaattaacaaggaccacatcgaatacgtaaagaagcaccgagacgatttcaaagaactcctcaactacgtccttgagttcaacgaaaaatacgtcggcgcgaccaaaaacggagaacgcctaaaagaggccgtcgcagacttcgactccaaatctaacgaagagatctgcacgtccttcctaggcgcggtgaactcgaagaacgcgggcttattcgaactcacttcactcggatctgcttccgatttcgagttcctcggtgtcaaaataccccgatacagagactacacccccagcagcttgctcaaggactcaaccctgatccatcaatccataacaggcctctacgaaacacgcatcgatctctccaaactaggagaagactga

SEQ ID NO: 6708 - RNA, 4161 nt, synthetic construct
  misc_feature 1..4161: note = Cas9 variant
  source 1..4161: mol_type = other RNA
atgaccaaaatcactgaagactacatcgtgggcctcgacatcggcaccaactcgtgcgggtgggtagccatggattccaaaaacactattctccgaatgcacggtaagaccgcaatcggaagccacctcttcgacgccggcaacagcgctgcagaccgacgagcctttcgtacgacacgtcggcgaatcaaacgtagaaaatggcgactcaagctactcgaggaaatattcgactcacatctagcaaaagtcgacccctacttcttcgcacgcctcaaagagtccgggctatcacccctagacacccgcaaaaacgtatcatcaatcatttaccccacctccctcgaagacaaaaagttctacgtggacaacccaacgatataccatctcagatacaaactgatgaccgaagaccgaaagttcgacctccgagaagtatacctggcaatccaccacatagtaaaataccgaggcaattttctctacaacactcctgtaaaggcgtttgaagcatccaaaatcgacgtcaaaggtagcctgaagaaactaaacgaattgtatgagggactcgacagtgagttcaacgttgaactggactccaacaacgccctggaaatcgaaaatataataagggacaagaagatctttaaaatcaacaaggtcaaggaaatcaaccaactcctcagcttaaaaaccgaggataaggaacgaacaaagctaatgaaagacgtgagcaaacaaattgtgaacgctatcctcgggtacaagaccaagttcgagaccatcctactcaaagacgtcagcaaggacgaggccgacgactgggagttcaagctcacagacgtagacgcagacaataaattcgaaaacctgatcggcgacctaaacgaaaacgaacaagagatcctcctagtcatccgaaagctcgcaaacgcaatcacactctcaaatattgtcgaggaaggcaagacactgtccgaatccatgaaagacaaatacaagaaacacagcgatgacctgaaactactcaagcaggtcataagcgaccacccagaccgagacaaggccaagaaactcgccctcgcctatgacctgtacgtgaacaaccgccatggcaaaatcctgcaagctaaagacatactcgagaaaaagaaaacgctctcaaaagaagacttttacaaagaaatcaagaaaaacctggacgacagcaaggaatcacaagaaatcctagacgcgatctctctggactcgttcatgccaaagcaacgcacgaacgaaaacggggtcataccataccagttacaccaactcgagctagacaagatcatcgaaaatcagggaaaatactacccattcctcaaggaagtcaaccccgtctcgtcgcatctcaagcaagcaccatacaagctcgacgaacttatacgattcagagtcccatactacgtcgggcccctcatatccccgaacgagagcaccaaaaacaaacaaaccaagaaaaatcaaaacttcgcctggatgatacgaaaggaacaaggacagatcactccctggaacttcgaccaaaaagtggatcgaatggccagcgccaacaaattcatcaaacggatgaccacaatagacacctacctattaggagaagacgtactccccgcgaacagccttctatatcaaaaattcacggtgctcaacgaactaaacaacgtcaaaataaacggtaaaaggatctcggtcccactcaaacaagagctttacaacaacttattcaagaagaactcgacggtcacgaccaacaagctcaagtcctatttaaaggaaaactacaaactaatcaaagtcgagataaaaggcctatcggacgaaaagaagttcaactccggcctcaccacgtacaacaagctgaagaatctaaaaatattcgaccaacaaatcgacgatccaaactacaacaaggactttgaacgaatcatcgagtggtcaacaattttcgaggacaaagccatatacaaggagaaattaaagacgatcgactggctgtccgaccgccaaatcgacaaactaagcaaaatacgaatgcaggggtggggccaactctcaaagaaactcctgtcccagctcacagataacaacgggcaaacaataatcgagcaactctgggactcccagaacaatttcatgcaaatagtaaaccaggcagacttcaaagacgcgatagcggtcgctaaccagaaccttctcgtcgatacctccgtagaagacatactcaacgaagcatacacctcccctgcaaataagaaagccatacggcaagtagtgaaagtcgtagacgatatagtaaaggcgacatcaggaaaagtcccaaaacaaatcgcaatcgagttcacgcgagacgccgacgacaacgccaagatatcccaatcccgcgcgaacaaactacgcaaagtatacaaagaaatgtccaacgagctagcttccgaaacaatacgcaacgagctagaacgggtagccaaggaccaaaaactcctaaaagacaaacactacctttatttcatgcaattaggccgggacgcatacacaggcgaactgatcgacatcgacaacctcgaacagtacgacatagaccacgtgctcccgcaatccttcatcaaagatgactcactggagaatcgtgtcctcgtgaagaaagccgtgaacaatggcaaatccgacaacgtacccgtaaaactgtacggcaacaggatggcaacagacctcggaatgactatccggcacatgtgggaaaaatggaaagaacaaggcctcataaccaaaaccaaatacaacaacctaatcatagaccccgacaagatcaataaatacgagagcagcggcttcatccacaggcaactggtcgaaacctctcaaatcataaaactggtcagcaccatcctgcaatctaaatatccagacacggaaataatagtagtaaaagcccgctacaaccactacctacgcaaacgcctgaacctctacaagagccgggaagtcaacgattaccaccatgcaattgacgcctacctaagcgcgatctgcggcaacctcctgtatcaagtttacccctacctgcggccattctttgtctacggacagtacaagaaattctcctccgagcccgaaaaagagaaaatcatatacgacaaaaccagacgctacaactttatctcccagatatttgaaaacaaggataacgacatcatctctcgcgaaactaagaagaaagtcttcgacaagaaagacataatcgaaaaactcaaaagagcctacaattataagtacatgcttgtatcccgagaaaccgagacccacgaccaggaaatgttcaaaatgacggtgtaccccaggctaagcagagataccaagaaatcgcgcaacctcatcccaaagaagaaagacatgcccaccgaaatatacggcgggtataccaacaacagcgacgcatacatgattatagcccggatcaacaaaaagaaaggccccgaataccgggtctttggcgtcccaatgcgcgaactcgtcaatctgcgtaaagccgagaaaaacggccattataaagcctaccttaaacaggtgctcgaacccgagatcatgtacagcaaaaacggtaagaaaaacaaaaccatcagctcattcgaaatcgtaaaagccaaagtcccatacaagcaggtaatcctcgatggcgacaaaaagttcatgctcgcctccagcacgtacgtacagaacgcaaaacaattaaccctgtcacaatactccatgcaggccatcaccgacaattgcgagaacgatactgaggaagaaaaagccctcgtcgaggcctatgacgagatactaaccaatatcgacaaatacctcccactgttcgacattaacaagttccgagagaaactacatgcgggcagggaaaagttcgtagacctccccctagctgaaaagaaagaaacaatcctccaagtactgaacgggctccacgataacgcagtgatgcctaaaatcaaatcactcggtctgagtactcccctgggattcatgcaatttcatacaggggtaagcctttcagagaacgcgaaattgatctaccaatcccccacgggcctcttcgaaaaacgactgaaaatctccgacctttga

SEQ ID NO: 6709 - RNA, 4164 nt, synthetic construct
  misc_feature 1..4164: note = Cas9 variant
  source 1..4164: mol_type = other RNA
atgtcagactcgaagaaattcgagggagaaaacgtaaaatcaggcgacaagaagacgaacaaaaaccacggcaaggtactcaaaagctcccccaaggaaattcggaaaaacaccgagtactttataggcctcgacatcggcacctcgagcgtgggctgggcagtcactaacaccgattatgagatcctaaagtttaacggaaagcggatgtggggatcccggctatttaatgaagcgtcaactgccgaggaacgccgcgggcatcgagtcaatcgacgccgaatacagaggcgtcgcgacaggctgaacctcctcgaggaaatcttctccgaagaaatggccaaagtggaccccgagttcttcatgcgtttaaaagaatccaagttccatctcgaggacaaagacgaacgtatactcggggaatccaacatcatctttaaaggatcagaggacggggataagaagtactacgaaaaatacccaaccatctaccacctaagacacaaacttatgcaaagctgcgaagacgtagacattcgcgaattatacatggccctccaccacattataaagtaccgagggcatttcctattcaaaggagacttcgaggaaacaggcaccagcatcgaaaacatcataatcgaacttctagaactcatcaacaacaacttaggcgtcaaaaagttcgaatacaacgaaagcctcatcaacgagctcaagaacatcgtcagcaatacttccaacaccatcaccaacaaaaagaagctgctaggagagttcttcaacaagaaggaatacaaagcccacaagtcactattcatcctatcaataggtgctagcgtaaaacccgtcgacctcttcctagaagaagagtacaaggacatagatgacatcaaaaacataagtttcaaaaatctagagtacgatcaagtacgagacacctacgaatccatcttcctggacaaaatcgagttcatcgatgtggcgaagcgtctgtacgatgcgaccatactgctcagtatcaaacccgaaggaaagaccctcagcgaagccaaggtggacatctacaacaaacatcacaatgaccttgagctcctcaaaaaggtccttaagaccgacaaagaaaaatacgatagcatcctaaaactcgacataaagaaaggcaacaactatgtcaactacgtcaagaaaagcaaaaacggcatcagctgcagcaaagaagagtttcacaacgccctcaagaaagttctcgtcaaaatagagaaaacggatgacataaaatacatattgaacgaaattgaactagagaggttcctccccctacaacgagtaaaagacaactcagtcatcccgtaccaaatacacagatatgaactcaagaagatcctcgagaatgcgagtaagaaattcacattcctaaatgaggagtcagatgggcacacgaacatcgagaaaatcataaaaatcatggaatatcggatcccatactacgtgggccccctcaacgaccaccacagcgtctacaacaatggattcgcgtgggtgtcccgcaaacggtccggcagaattacgccatggaactttgacgaaatggtggacaaggaagagtcggctgagcgcttcatcgaaaacctaacgaacaaatgttcatacctcatcggggaagatgtgctccccaaagaatcactcctatatagcgagttctcgctacttaatgaactgaacaacatcaaatatgatggcatctccctacccatagacataaagaaaagcatcgtcgaaaagatcttccgcgtggaaaagaaaagagtcactaaaaagtacatcaaagagttcctcaaacaggaaggatacagcgacggcaagggggaggtctcggggatcgacatcgacataaaatcggacctcaagtcgtaccgcgacatggtaaagatcttcggcacagagatcgattaccgtatggccgaaaatataatcaaatgggtcacactgttcggagacagcaaagatctgttaaaaacgaagatcaacaaagagtacggagaaaaagtctcaaaggaccaactgaagaaagtatgcaaacttaagtatagagactggggaagactctccaagaagttcctaacaggcatacgttcctccgtactggtgaacgatgcaaccggcgaaggatacacaatcatcgaagccatgcgcaacaccgataacaaccttatgcaattgctgagaaacgaatacgactacctcaaaaagatcgaccaaataaatatgctatcacggaaagacattgatgagataagtcacgacatactagacgacctatactgttcaccagccgtaaaacgaagcctctggcaaacgataaagatcgtggaagaaatcaaaaagataatgggccacgagcccaaaaaggtattcgtcgaagtaacccgaaccaacaaagccgacaagaaaacgacaataacccgcaaaaacagacttctggagctctacagcgccatcaacgccgaatcaagagactgggtcaacgaactcaacagcaccgaagtctctaaattcaactcgaagaaactatacctatattacacacagatgggcaaatgcatgtacaccggcaaaaacatagacatcgaatccctattcacagacatgtacgacatcgaccacatcttcccgcgatcaaaaaccaaggacaacagctttgagaacctagtcctcgtcacccgcaaagcgaatgccgacaaacgcgacgtctaccccatagaccccaaaatccaaaccgaacgaaaaagcctatgggacatgctacacgacaagaaacttataggagacaagaaatacgacagactaacgagaaccacgggtttcacagacgacgaaatgagcgggtttatcgcccgccaactcgtggaaaccagccaagctagtaaagcggccgcggagatgttaaaactcataaacaacgactccgaaatcgtctacgtaaaagccgagaatgtgtctgactttagacatgaaaacgagttcatcaaagtacgagaaataaacgaccaccaccacgccaaggatgcctacctaaacatcgtcgtcggtaacgtgtataatgaaaaattcaccaaaaacccagccaactatatcaagaaaggtggaggaaacaactactcgctgaactgcatattcaacaggaacctcgaccgaaacggtaaacgcatctgggacgaaaagaaaagcatcgacactgtaaaccgaatgatgaaaagcaatgacgtaagagtcacattcaaaaacagggtggacaaaggccctatcttaaacaaggtcaccatacataaggcctcagaatttatggacgacggcaaaaagaataagaagggattccccatcaaatcctcagaaaagaacggaaacaaccgcctttgcaacctgtacaaatatggaggctacaaggacctaaactatagccactacaccatcgtgcgatacaacgtctacgagaaaaagggcttagatattaagtactatatgatccccatcccgtactacctgtgcctttgtaacatcaaccaacacgactacgtatacgattacataagcaaccgcagcaagaaagatgtcaacaacattgaaataatcgtcaacgaactgaaaatggggtccctcatcaacatcgacggttacaactattacctcggagggtcaaagccaaagaccttctacgtcgacccggcctatcagatcatcctagacaaagaaatcgagcgctgcatcaaggagatagtcaaagccaaaaacaacgagtaccgcttcatcaataccgacaaaataaataaaaacctcaacatgaagatctataaatacatcgtaaacaagaaaatcatcggggtcttccgtaaccgcaaatgggacaaaggagagtacctcaacagttccgaaacaatcgaaaagttcagtgggctcagcgtcgaaagccagtgcaacgtcatcctccgcctaatcaacgacatgcgaggctcaaacaagggaggcgccaactcgaaattcgacgagctagaaatgacaatatcaagggccgaaatccctcaaaccttatcaaacgttagttcgttcaagattatcaatcagagtataaccggcctattcgagaacgaagtgaccatagtatga

SEQ ID NO: 6710 - RNA, 4167 nt, synthetic construct
  misc_feature 1..4167: note = Cas9 variant
  source 1..4167: mol_type = other RNA
atgaccaaaccctacagcatcggccttgacatcgggacgaactccgttggctgggcagtcatcaccgatgactataaagtgccgtcgaaaaagatgaaggtcctaggcaatacctcgaagaaatacataaagaaaaatctgctaggagccctgctattcgactccggcatcaccgccgagggccgccgactcaaacgaacagcacgacggcgctacaccaggcgtcgcaaccgcatactctacctacaagaaatcttctcaaccgaaatggcaacgctcgacgacgccttctttcaacgactagacgactccttcctcgtccccgacgacaagagggactcgaagtatccaatattcgggaacctagtagaagaaaaggcataccacgacgagttccccaccatctaccacctacgtaaatacctcgccgacagcaccaagaaagccgacctacgtctcgtctatctcgctctcgcccacatgataaaataccgcggtcacttcttaatagaaggagagttcaacagcaaaaacaacgacatacagaaaaatttccaagacttcctcgacacatacaacgcaatattcgagagcgacttatcactcgaaaattccaaacaactcgaggaaatagtcaaagataaaataagcaaattagagaaaaaggaccgcatcctgaaactcttcccaggggaaaagaactccggcatcttctccgagttcctcaagttaatagtaggaaaccaagcagactttaagaaatacttcaacttagacgagaaagcgtccctccacttctccaaagaatcttatgatgaagacctcgaaacactactcggctacatcggcgacgactactccgacgtgttcctcaaggccaagaaactctacgacgccatactcctgtccggaatcctaacagttactgacaacggcacagaagcacccctctctagcgccatgatcatgcgctacaaagaacacgaggaagatttagggctactcaaagcctacatccggaacatcagcctggagacgtacaacgaagttttcaaagacaattcaaagaacggatacgcaggttacatagacggcaaaaccaaccaagaagatttctacgtgtacctaaagaacctcctaagcaacttcgaaggcgcggactacttcctcgagaagatcgaccgagaagacttcctgcgaaagcaacgaacattcgacaacggctctatcccctaccaaatccacctacaagaaatgcgagcaataatcgacaaacaggctaagttctacccgttcctggccaacaataaagaaagaatcgaaaagatactaaccttcaggataccttactacgtcggaccgttggcccggggaaactccgacttcgcttggagcatccgaaaacgtaatgaaaagatcactccctggaacttcgaagatgtcatagacaaagaaagcagcgccgaggccttcatcaaccggatgaccagcttcgatctctacttaccggaagagaaggtgctaccaaagcactccctactttacgaaacattcaacgtttacaacgagctgacaaaggtcagatttattgcagaatcgatgtctaaataccaatttctcgacagcaagcagaagaaagacatagtccgactctacttcaaagacaaacgcaaggtcacggataaagacataatcgaatacctccacgcaatagacggctacgatggcatcgagcttaaaggcatcgaaaagcaattcaactcctcgctgagcacataccacgacctacttaacatcattaacgacaaagagttccttgatgactcctcaaacgaagcaataatagaggaaataatccacacccttaccatcttcgaagaccgggagatgatcaaacagcgactgtcgaaattcgaaaatatcttcgacaaaagcgtactaaagaaactctcgcgccgccattacaccgggtgggggaaactgtctgcaaaactcataaatggtatccgcgatgaaaaatccggcaacacaattctcgattacctcattgatgacggcatctcgaaccggaacttcatgcagctgatccacgacgacgcgctcagcttcaaaaagaaaatacaaaaagcccagataataggagacgaagacaagggcaatatcaaagaggtcgtcaagtcactcccgggctcccccgcgataaagaaaggaatcctccagtcaatcaagatcgtagacgaactcgtgaaagttatgggcggcaggaagcctgaatccatagttgtggaaatggcaagggagaaccaatacaccaaccaaggaaaatcgaactctcaacagcgtctcaaaaggctggaaaagtccctcaaagagctcggcagcaagatcctcaaagagaatatcccagccaaactcagcaagatcgacaacaatgccttacaaaacgatcgcctatacctatactaccttcagaacgggaaagacatgtacacaggtgacgatctcgacatcgacagactcagcaattacgacatagaccacattataccacaggccttcctaaaagacaacagcattgacaacaaagtcctagtgagttccgcctcaaatcggggtaaaagtgacgacgttccaagtctagaggtagtcaagaaacggaaaacgttatggtaccaactcctgaaaagcaaactgatctcacaacgtaaattcgacaacctaaccaaggccgaacgcggcggccttagcagggaagacaaagcctcgttcatccaacgccagctcgtcgagacccgacaaattaccaaacatgtagcacgccttctagacgagaagttcaacaacaagaaggacgagaacaaccgagccgtgcgcactgtgaaaatcatcaccctcaaaagcaccctcgtcagccaattccgcaaagacttcgagctatacaaagtacgcgagatcaacgacctacatcacgcgcacgacgcgtatctaaacgccgtggtagcttctgcgctacttaagaaataccccaaattagaacccgagttcgtctacggtgactaccctaaatacaacagcttccgcgaaagaaaatccgccaccgaaaaggtatacttctactccaacataatgaacatattcaagaaatccatatcgctcgctgacggcacagtaatagagaagccgcttatcgaagtcaatgaagaaacaggagaatccgtctggaacaaagaatcggacctcgccacggtaagaagagtcctcagctacccccaagtcaacgtagtaaagaaagtcgaaaaacagaaccacgggctcgacagaggtaaaccaaaaggcctcttcaacgcaaacctaagctcaaagcctaaacccaatagcaatgaaaacctagtcggagcgaaggaatacctcgacccgaaaaagtacggcggctatgcaggaatatcgaactcattcgccgtcctagtaaagggcacaatcgaaaagggagccaagaagaaaatcacaaacgtcttagaatttcagggaatatcgatcctcgaccgcattaactatcgtaaagacaaactcaacttcttgctcgaaaaagggtacaaagacatcgaactcatcatagaactcccaaaatactcccttttcgagctcagcgacggctcacggcgaatgctagcctcaatcctgagcacgaacaacaagcgtggcgaaatacacaaaggaaaccaaattttcctctcgcaaaaattcgtgaaactcctgtaccacgctaaacgcatatcaaataccatcaatgaaaaccaccgcaagtacgtagagaaccacaagaaagagttcgaggaactgttttactacatcctcgagttcaatgagaactacgtcggggcgaaaaagaacggtaaactcctcaactcagcattccaatcttggcaaaaccattcaatcgacgagctctgtagctccttcataggccccaccggtagtgagcgaaaaggactgttcgagctgacatcacgggggtcagcggcagatttcgagtttctaggcgtgaaaatcccacgctacagagactacacaccatcatcactactcaaggacgcaactctgatacaccaatcggttaccgggctctacgaaacgcgaatcgacctcgccaaactaggcgaaggctga

SEQ ID NO: 6711 - RNA, 4167 nt, synthetic construct
  misc_feature 1..4167: note = Cas9 variant
  source 1..4167: mol_type = other RNA
atgacgaagccctactcaataggtctagacattggaacaaattctgtcggctgggccgtaatcaccgacaactacaaagtcccgtccaagaaaatgaaggtccttgggaacacctcgaaaaagtacatcaagaaaaacctactcggcgttctcctcttcgattcaggtatcacggccgaaggtcgtcgccttaagcgaaccgcccgccgccgttacaccagacgccgcaaccggatactatatctacaagaaatcttctcaacagaaatggctacgctagacgacgcgttcttccaacgtctagacgactctttcttggtaccggacgacaagcgcgactctaaataccccatcttcggcaacctggtcgaggagaaagtgtaccacgatgaatttcccactatataccacctccgcaaatacctagccgactcgacaaagaaagcagacctacgactcgtctacctcgcacttgcccacatgatcaaataccgcggacacttcctgatcgagggtgagttcaacagcaaaaacaacgacatccagaaaaatttccaagacttcttagatacctataacgccatcttcgagtcagacctgtcattagaaaacagcaaacagctggaagagatcgtaaaggacaagatatccaaactggaaaagaaggacaggatcctaaaactcttcccaggcgagaaaaacagtggcatcttcagcgagttcctaaagctaattgtgggtaaccaagctgacttccgtaaatgcttcaacctcgacgaaaaagcctccctccacttctccaaggaatcctacgatgaggatcttgagaccctactagggtacataggtgacgactactcagacgtcttcctcaaagccaagaaactctacgatgcaatcctgctctcaggcttcctaacagtcacagacaacgaaaccgaagcgcctctgtcgtccgccatgattaaaagatacaacgagcacaaagaagacctggcactactcaaggagtacatcagaaacatctctctcaaaacgtacaacgaagttttcaaagacgataccaaaaacggatacgccggctacattgacggcaagaccaaccaggaagacttctacgtctaccttaagaacctactcgccgagttcgaaggtgcagactatttcctcgagaaaattgaccgcgaagatttccttcgtaagcagcgcacattcgacaacggctcgataccgtaccaaatacatctgcaggaaatgcgcgcaattctggacaaacaggcaaaattttacccattcctcgccaagaacaaagagcggatcgagaaaattttgactttccgtatcccgtactacgtcggccccctggcaaggggcaactctgacttcgcctggtccatacgcaagagaaacgagaagataacgccatggaactttgaagacgtcattgacaaagaatcgtccgccgaagcgttcataaacagaatgaccagctttgacctgtacctgcccgaggaaaaagtcctcccaaaacactccctgctctatgagacattcaacgtctacaacgaattgaccaaagtccggttcattgcagagtcaatgcgtgactaccaattcttagacagcaaacagaagaaggacatcgttcgtctttacttcaaggataaaaggaaggtcactgacaaagacattatcgaatacctccacgccatatacggttacgacggcatcgaactcaagggaatagaaaagcagttcaactcatccctatcgacgtatcacgacctacttaacataattaacgacaaagagttcctcgacgactcctctaacgaagccatcatcgaagaaatcatccacaccctgacaatattcgaagacagagagatgatcaaacaacgactatccaagttcgaaaatatattcgacaagtctgtcctcaagaaactctcgcgacgacactacactggctggggaaaactatcggccaagctcataaacggaatccgagatgaaaagtcgggcaacacaatccttgattacctcatcgacgacgggatcagtaaccgcaactttatgcaactgatccacgacgacgcactatcctttaaaaagaaaatccaaaaagcgcagataataggcgacgaagacaaaggcaacatcaaggaagtggtcaagtcactccccggctctccagcaataaagaagggcattctacagtctatcaagattgtagacgaacttgtcaaagtaatgggcgggaggaaacccgaaagcattgtggtggaaatggcgcgagaaaaccagtacacgaaccaagggaaatcaaattcccaacaacgcctcaaacgcctcgaaaagtcactcaaggaactaggcagcaaaatcctaaaagagaacatccccgcaaaactctccaaaatcgataataacgcacttcaaaacgaccgactctatttatactacctgcaaaacggtaaagacatgtacacaggagacgatctagacatagatcgcctatccaattatgatatcgaccacatcataccccaagccttcctcaaggataactcaatcgacaacaaggttctagtctcttctgcatcaaaccgcggcaaaagcgacgatttcccctccctggaagtagttaagaaacgaaaaaccttctggtatcaactactcaaatccaaactcatctctcaacgtaaatttgacaacctaacaaaagccgaacgcggagggctcctacctgaagacaaagccggattcatacagcgacaactcgtcgagacccgccaaatcaccaagcacgtagcaagactgttggacgaaaaattcaacaacaagaaagacgaaaacaaccgtgcggtaagaaccgtaaaaattataaccctcaaatcgaccctggtctcccagttccgcaaagacttcgagctatacaaagtccgcgaaataaatgatttccaccacgcccacgacgcttacctcaacgccgtcatcgcgagcgcactgttaaagaaatacccaaaactagagccagagttcgtgtacggagactatcccaaatacaacagcttccgagaaagaaaatcagccaccgaaaaagtgtatttctactccaacatcatgaacatcttcaagaaatccatctcactggccgatggacgcgtcatcgaacgccccctaatagaagtaaacgaagaaacgggagaatcggtctggaataaggaaagtgacctagcaacggtacgacgggtcctctcctacccacaagtcaacgtagtcaaaaaggtagaagaacagaaccacggactcgatcgaggaaaacccaaaggactgttcaacgccaacctatcaagcaagcccaaaccaaattccaatgaaaatctagtgggcgcaaaagagtacctagacccgaagaaatacggcggctacgccgggatatccaactcattcgcagtcctagtaaaaggcaccatcgagaaaggagcgaagaagaagataaccaacgtcctagaatttcaaggcatctcgattcttgaccgcatcaactaccgaaaggacaagctcaacttcttactggagaaaggttataaagacatagagctcatcatagaactccccaaatacagcctgttcgaactcagcgacggaagtcggcggatgttggcgtcgatcctatcaaccaacaacaagcgcggagagatccacaaaggcaaccaaatatttctgtcccagaaattcgtaaaacttctataccacgcgaaacgcatttcgaacaccatcaacgaaaaccaccgtaaatacgtcgaaaaccacaagaaagagttcgaagaactattttactacatcctagagttcaacgaaaactacgtcggcgctaagaaaaacggcaaactactcaattcagcattccaatcatggcaaaaccacagcatcgacgagctgtgtagctcattcatcggaccaaccggctcagaacggaaaggactgtttgaactgacaagccggggcagcgccgcagacttcgagttcctcggcgtaaaaatcccccggtaccgcgattataccccctcaagccttctcaaagatgccacgctaatccaccagtcagtaacaggcctatacgaaacccgcatcgatctcgcaaagctgggagaaggatga

SEQ ID NO: 6712 - RNA, 4167 nt, synthetic construct
  misc_feature 1..4167: note = Cas9 variant
  source 1..4167: mol_type = other RNA
atgaccaaaccatattccatcggcctggacatcggcacaaatagcgtcggctgggccgtcatcacagacaactataaggtccccagcaagaaaatgaaagtcctaggtaacacgtcgaaaaagtacatcaaaaagaacctcttaggtgtactcctcttcgactcaggcatcacggccgaggggcgcagactcaaacgaaccgctcggcggcgatacacacgaaggcgcaatcgcatactatatcttcaggaaattttcagcacagagatggccacgctcgacgacgccttcttccagcggctagacgacagcttcctcgtccccgacgacaagcgagacagcaaatacccgattttcggcaatctagtcgaggaaaaggcctaccatgacgaattcccaaccatctaccacctcagaaagtatctagcagactcaaccaaaaaagccgaccttcgcttggtctacctagccctcgcccacatgatcaaataccgggggcacttccttatagagggcgaattcaattcaaaaaacaacgacatacagaaaaactttcaagatttcctagacacctacaatgccatattcgaatccgacctatccctcgagaactcaaagcagctcgaagagatcgtaaaggacaaaatctcaaagctagaaaaaaaagacagaatactaaaactttttcccggagaaaagaacagcggaatcttctccgagttcctaaagctgatcgtaggtaaccaagccgacttcagaaagtgcttcaatctagacgaaaaagcgtcactacacttctctaaagagagctacgacgaggacctagaaactctacttggctacatcggagacgactactccgacgtatttatcaaggcgaaaaagctctacgacgctatcctcctttccggattcttaacagtgacagacaacgaaacagaagccccgctctcctccgccatgatcaaacgttacaacgaacacaaagaagatctggcgctcctaaaagagtacatacgaaatatctcactgaagacctacaacgaagtgttcaaagacgacacaaaaaatgggtacgccgggtacatagacggaaagaccaaccaagaagacttctatgtttacttgaagaacctcctcgcggaattcgagggagcagactactttctggagaaaatagaccgagaggactttctacgcaaacagcgaacgtttgacaacggtagcataccctaccaaatccacctgcaagaaatgcgcgccatcctggacaaacaagccaagttctaccccttccttgctaagaacaaggaaaggatagaaaagatcctaacgttccggatcccctactatgtcggcccactagcccgcggcaatagcgatttcgcgtggagcatccggaaacgcaacgaaaaaatcacaccctggaactttgaggatgtcatagacaaagagagcagtgccgaggccttcatcaataggatgacaagctttgacctctacctgcccgaggaaaaggtgctccccaagcactcactactctacgaaaccttcaacgtctacaacgagctaaccaaggtccgattcatcgccgaaagcatgagagactaccaattcctcgactcgaagcaaaagaaagacatcgtacgtctatacttcaaagacaaacggaaagtaaccgacaaagacatcatcgaatatctgcacgcgatatacggatacgacggaatcgaactcaaaggaatagaaaaacaatttaactccagcctgtccacctaccacgacctactcaacatcatcaacgacaaggaatttctcgatgactcctctaacgaagcaatcatagaagagatcatccacactctaacaatattcgaagacagagaaatgataaaacaacggctctcaaaattcgaaaacattttcgacaaatccgtactcaaaaagcttagccgccgacactacacgggatggggcaagctttccgccaaactcataaacggaatccgagacgagaagagcggtaacacgatcctggattacctaatcgatgacgggataagcaaccgaaacttcatgcaactcatacacgacgatgccctttcattcaaaaaaaaaattcaaaaagcccagataatcggagatgaagacaagggcaacatcaaggaggtggtcaaatccttacccgggtcaccagctatcaaaaagggaatcttgcaaagcataaaaatcgtagacgagctggtgaaggtgatggggggccgcaaaccagagtccatagtagtcgagatggccagagaaaatcaatacaccaaccaaggcaaatcaaactcccaacaacgactcaaaagactcgagaaaagcctgaaagaacttggcagcaaaatccttaaagaaaacatcccagcaaaactctccaaaatcgataataacgctctccagaacgaccgcttatacctctactatctccaaaacggaaaggacatgtacactggcgacgaccttgatatcgaccgcctgtcaaattacgacatagaccatatcatcccccaagccttcttaaaagacaattcgatagacaataaggtcttagtctcaagtgcgagcaacagaggcaaaagcgacgacttccccagccttgaggtcgtcaaaaaacggaagaccttctggtaccaattactcaaatcgaagctaatctcgcaacgaaagttcgataacctcaccaaagcagaacgcggcggcctactgcccgaagacaaagccggatttatccaacgccagctagttgaaacccgccagataacaaaacatgtggcccgcctactggacgagaagtttaacaacaaaaaagacgagaacaatagagcggtacgcacagtcaaaatcataaccctaaaatcaacactggtctcccaattccggaaagacttcgaactctataaagtacgcgaaatcaacgacttccatcacgcccacgacgcctacctgaacgccgtaatagcctccgccctccttaaaaagtacccgaaactcgaacccgagttcgtatacggcgactacccgaaatacaactctttccgcgaaaggaagtctgccacggagaaagtatacttctacagcaacatcatgaatattttcaaaaaaagcataagcctcgcggacggacgcgtcatcgaaagacccctcatagaagtcaatgaagaaactggggaaagcgtgtggaacaaggaatcagacctagccaccgtacgacgcgtactatcctacccccaagtcaacgtggtcaaaaaagtagaagagcaaaaccacgggttagaccggggcaaaccgaaaggcctgttcaacgcgaacctctcaagcaaaccaaagcccaacagcaatgaaaacctagttggggccaaagaatacctggacccaaagaaatacggcggatacgcggggatctccaacagtttcgcagtcctcgtcaaaggcaccatagaaaagggggccaagaaaaaaataacgaacgtattagagttccaaggaattagcatcttggataggataaactaccggaaagacaagcttaacttcctcctagaaaaaggctataaggacatagaactaattatagaactcccaaaatactccctatttgagctatcggacggctcacgccgaatgctcgcctcaatcctaagcaccaacaacaaacgaggcgagatccacaaaggcaaccaaatctttcttagccaaaaattcgtcaagctcctataccacgcgaagcgcatatcaaacaccattaacgagaaccaccgcaaatacgtcgagaatcacaaaaaagaattcgaggaattattctactacatcctcgaattcaacgaaaactacgtaggcgccaaaaaaaacggtaaactgctcaactccgccttccaatcgtggcaaaatcacagcatcgatgagctgtgctcaagcttcatcggccccacagggagcgagcgaaaaggcctcttcgaactgacctcccgaggaagcgccgccgacttcgaattcctcggggtaaagatccaacgctaccgcgactacaccccatcaagtctgctgaaggacgcgaccctcatacaccagtcagtaacgggactctacgagacccgcatcgacctagccaaactaggagagggctga

SEQ ID NO: 6713 - RNA, 4167 nt, synthetic construct
  misc_feature 1..4167: note = Cas9 variant
  source 1..4167: mol_type = other RNA
atgaagcgcatccttggcctagacttgggaacaaactccatcggctgggccctggtcaacgaagcagagaacgaaaaggaaatctctaagattatcaagttaggtgtgcgagtcaacccgctgacaatagacgagaaaaccaacttcgaaaagggccgccccctaagcacgaatgccgaccgaacactcaaacgcggcgccagacgcaacctacagcgatacaaactcagacgagagaacctaatcgagatcctcatcgacaaccacataatcacaaaagaaacgccactcaccgagataggcaagggtaccacctaccagacgctatctcttcgcgccaaagcagtccgcgagcgaatagatctagaagactttgccaaagttctcctcgcaatcaataagaaacgcggctacaaaagcagccggaaagccagcaatgacgaggagggtcaagcaatcgacggaatggcaatcgccaaagagctttacgaaagaggtatcacccccggccagtacgtcttggagctgcttgaaaacgaccgaaaatacatccccgacttctaccgatctgacctcaaacaggaatttaacaaaatatggaacaaccagaaaacattctacccagaaatccttaccgacgaactcttcaaggaactcgacggcaagaataaaagtcaaacgtgggcgatatgccagaagccattcaacataaaaggcatcaaacgtataaccaaaggaagggaaaagaccatagaaaactaccactggagagtcaaaggtttaagcggaaaactaaacctggagaaactcgccataatcctgcaagaaattaacaacgacataaaccaatccagcggctacctcggcgggatttcagacaaatcaaagaaactttacctcaacaaagaaaccgtaggggagttcttatacaaacaaatcgccaagaatcctcatacaagcctcaaaaaccaagtcttctaccgtcacgactacctagacgagttcgaacaaatctggaagacacaatccaacttcaacgccaatctgacagacgagctgaagcaggaaatccgcgacgtaatcatcttctaccagcggaagataaaatctcagaaatcactcatttccttctgccagttcgaaagctgggagcaagagtatttcgacaaggaaaccggcaaaaccaagacccggaccgtaggaagacgcgtcatccccaagagcagccctctattccaagagttcaagatctggcaaaacctgaatcacctcgttttcacaaattcagaaacggacgagaaaatcgaaatcaaagaagtcgagcaagaaatacggaaagaacttttcgaggaactgaacctccgaggagacctcaacccaaacgacctcctgaagattctccgcagtcagttcaaaattgggaagctatcgaattggaaatgcaacttcgaaaagatcgaaggcaatcgaaccaatgccgccctgttcaacatataccagaaaatcagcgacttcgaaggttacggaatagactggaacaaaagcaatgccaagaaaatccgaaaagaactaaaggcaaccttccccgagatcgggatcgacgcctcgatcctcgagttcgacgcgtacaagaaacaattgacaaaccaaagcagctacgaactttggcatctgctctactcagcagaagaagactttaaaatatccgaacaagacaaactaatctacggtaactcatccgttagcctgaaaaagaagctacacttaaaattcgggttcaaccccgaatacgcgaaaatgctagccaatctatctctcatgtccgactacgggaacctgtcggcgaaggcaatcaagaaaatcttaccatacctagaagacggccacctgtactccgaagcctgccgcctagcgggatacaaccactcaaaaagtctcaccgccgaagaactcgaaaaattcgagcccaaagccaaactagacctcctcaagaaaaacagtctcagaaacccggtagtagagaaaatcctcaaccaaatggtcaatgtggtaaaccaagtaatcgacacctacggcaaaccagacggagtcagaatcgaactcgcccgcgaactcaaaaagtccgcgaaagaacgagcagagatgacgaagggcatagcggacggcacgcgacgcaacgaagaaataaagaaaatcatcacacagaaattcggcatcccgaacccgaccaaatcagacctcgtacgatatcgcctctggcaagaactagaaagccgcggctacaaagatatattcacagacaagtacatcagccccgacaagatcttcagcagcgaaatagacatcgaacacataatccccaaggccctcttattcgacgactccttctccaacaaaacactctcattccgcaacgtcaaccttaaaaaggccaaccgaacggccctcgacttcatcacgcaggactaccagtccaacgtcgaagcgtacaaggagcgagtcgaaacttggaacaaggacaatcacatttcaaaggggaaacggaataaactcctcatgagcctcaaagacatccccgacgggttcatcgaaagggatctcagaaactctcaatatatcgcgcgaaaagctaagagaatgctttatgaagtcttcccaaacgaagtcctagcaacatccgggtcgatcactgacaagctccgcagcgactgggaccttatcaacgtcatgaaagagctcaacctcccaaaatacaaagccctcggcctaaccgagtatgaagaacgtctggacaaaggcactgaagaactcttcaagcacgaagtgattaaggattggaccaagcgcaacgaccacaggcaccacgcgatggacgccctggccgtcgccttcaccacacacaaccacatccaatatatcaataatctcaacgcgcgcaaagacataactcaagacaaccaccccataatcaaaaatatcgagaacctaataactgaagtaaactcaaaaggcaagcgagtgttcaaagcacctatgagctcattcagggaatcggcgaaagagcagatagaagcaatacttgtctcgttcaagaacaaaaacaaagtcgtgaccaaaaacataaaccaaaccaagaaagagggcggattcaactaccaaaacgcgaaaacacccagaggacagctgcacaaagaaaccatctatggcaaaagcaaacaacctctagaaaaacccgtgaaaataaacaaccgcttctgcaaaaagcaagtcggtctaattatcaattttaaagagcaagaagccgtcctacaccacctcaagaaatacgacaacaacgagaaaatagccttctcaaacaaaactcttaaatctgaccccatccaagttaatggctcacccctccgcgaagtaaaaatcttcgaagaaatctttaccatccgaaaagatattaaccccgacaacttcaagacgcaaaagcaccttgacaagatcatcgacaagggcatcaaagaagtaatgaagaaacggctagaggagtacaacggcgatttcaaaacggctttctccgacctagacaaaaacccgatctggctcaaccagtccaaaggcataacgatcaaacgcgcgacaatatcgggggtgacgaacgcagaaccactccaccaagccaaggatcacctggggaacataatactagacgacaatgggaaagagatacccatcgactacgtcagcacgggcaacaaccatcatgtagctatataccaggacgaatccggtaatcttcaagaagaagtagtctcgttttatgaggccgtaatccgcaaaaaccaagaccaacccataataaagaaacgccaccccaaaggttggaaattcctcttcaccatgaaacaaaacgagatgttcgtcttctcatccgaaaacttcaacccgagcgagatcgatctcctggacgagaaaaacgcagctatcatttcaccgaacctctttcgcgtgcagaaaatcgcaacgaaaaactacatgttccgacaccacctggaaaccgaggtcaccaacaacctcgacttcacctaccgccacttccaagcgaccgagtggctccgaaacctgtgcaaagtacgcatcgaccacataggacgaatagtgcaaatcggagaatattga

SEQ ID NO: 6714 - RNA, 4170 nt, synthetic construct
  misc_feature 1..4170: note = Cas9 variant
  source 1..4170: mol_type = other RNA
atgataatacgaacgtatgagttaaaaacaatcactactatagctattctaaagatgttccaactactaaccggagggctcagcatgaccaagctcgggaaaccgtacgggataggggtcgacatcggctcaaatagcataggcttcgcggctgtcgacgaaaattcacacctaatcagacttaagggaaaaaccgtcatcggtgcccgcctcttcgaagaagggaaggcagccgccgaccggcgagcaagccgaacgactcgacggcgcctcagcagaaaccgatggcgcctgtccttcctccgcgactttttcgagtcacacataacccccacggggcccaacttcttcatgcgccaaaaatacagcgaaatctccccaaaggataaagccagatacaagtatgagaagagactcttcaacgatcgcaccgacgccgagttctaccaacaatatccaaccatgtatcaccttcgcaacaggctattgaccgatccgagcaaagctgacgtacgtgagatctatttcgccattcaccacattctaaagtcgcgcggccacttcctaaccagcggctacgctaaagacttcaacaccaataaagtagccctcaatgaaatcttcccggccctacaagacgcatacgcccaagtgtacccagacctcgacatcacgttcgacgagaacaaagtaaacgagttcaaaaccgtgctactaaacgaaaaggcgacgccatcagacactcaacgagccctcgtcaacttgctactcgccgaagacggcgacaaagacatcttaaaacagcagaaacaggtgctcaccgagttcgccaaagcagtcgtagggctaaagacaaagctcaacgtagcactaggaacagaagttgacagctccgaagctacagtatggaacttttcactaggccaactagatgacaaatgggccggcatcgaatccgccatgacagacgaaggcaccgaaattctagaccaaatccgcgacctataccgggcccggctactcaacggtatagtaccagcgggcaaaacgctctcgcaagccaaagtagacgactacgcgcagcaccacgaagacctggagctctttaaagactaccttaagcaactagaagatgacggaaccgccaaagcaatccgacaactgtacgaccgctacatcgacggtgacgatgcgaaaccctttgtgagagaagactttgtcaaagccctcacaaaagaagtcaccgcccatcccaatgccaagagccccgaactacttgagcgcctagcgcaaccagacttcatgctaaagcaacgtaacaaagcaaacggcgccatcccagtccaaatgcaacagcgcgaactagaccaaattatcaaaaatcaaagcgtctattacgactggttagctgccccaaaccccgtagaaaaacaccgcaaatccatgccctaccaactcgacgagctcttaaacttccgcataccatactatgtcggccctctggttaccgcaaaagaacaaaaagccgcacaaggaggggttttcgcatggatggtgagaaaagacccagacggaaacataaccccctacaatttcgatgaaaaggttgatcgtgaagcaagtgcgaacacattcatccaacggatgaaaaccaccgacacctacttaatcggcgaagacgtgttacccaaacaaagcctactctaccagcgatacgaagtactcaatgaactaaacaacgtgagagtaaacaatgaaaaactatctatcgaacaaaaacagcaggtcatacgcgagctgtttgaaagacacaacagcgtgacaatcaagcaattcgccgaaaacctacgggcgcacggggactacgcacacatcccggagatacgaggcctcgccgacgagaagcgctttctctccagcctcagcacataccgtcaactaaaatcgctgctccccgacgcaatagacgaccccgccaaacaagcagacatcgaaaacatcatagcctggtcaacagtcttcgaagacgccgccatcttcaaaacgaaactaaaggaaataaactggctcgatagtcaaacgataaccaagctcagcaacatcagatatcgcggatggggccaattctcgcataaattcctaaacggacttacactcggcaacggacataccatcatccaagaactattcctcagcaacaacaatttgatgcaaatactgaccgacgaaaccctccaaaagaaaatgacagagctaaacgcagacaaactcaaagccgcaaacatcaacgacgcgatcgacgacgcatacacaagccccagtaacaagaaagcactccgccaagttctccgggtaatcgaagacatcaaacgcgccgcagacggacaggatccaagctggctatacgttgaaaccgccgacgggggcggaacgccgggcaaacgcacacgagcaaggcagcaccaattacaagaaatctacgccaacgccgcgcacgagcttatcgactccgccgtccggggagaactcgaagacaaaatcgccgacaaagcagacttcaacgaccgcctagtgctatacttcatgcaaggagggcgggacatctacaccggaaccccactaaatatcgaccagctatcctcctacgacatagaccacatcctaccacaaagccttattaaagacaactccctcgataaccgcgtactggtccacgccattataaacagagagaaaaacgccaccttcgcttcaacaatatacgcccagaaaatgaacgccacctggcgtcaatggcacgaagctggcctaatatcaggacgcaaactccgcaacctccaaatgcggcccgaccaaatagacaaatacgcaagtggcttcgtcgcccgtcaactggttgaaaccaggcaaattataaaactgaccgaacaaatcgtggcagcccaatacccagaaactaaaatcattgccgtcaaagcagggctatcgcatcaattaagagaggaactcgagttccccaagaaccgggacgtaaaccactatcaccatgcattcgatgccttcctggccgcccgcatcggaacctacctcctcaagcgattcccaaacctgcaggcattcttcacatacggaaaattcaagaaagccgacgtgaagaaactgcgcggctttaactttatacgagacataacacatgccgaagacaaaatagtcgtcaaagacaccggagaagtaatatgggataagaaaagagacgtagacgaacttgaccggatatacaactttaaacggatgctaatcactcacgaagtacacttcgaaaaagccgacctattcaaacagaccgtctacggggccaaagactccaaagaagcaggcgggaagaaacagctaatctccaaaaagaaagggtacccagtcgacatatatgggggctatacccaggaaaccgggtcatacctatcggtcgtacgactcaccaagaaagctatgtacgcagtggtaaaagtctctaccagggacgcagcaaaactagccgtagccaaatccatctccgaacagaaagaaaacgaaacactcaacgacatcatagacgaaaaactctccaaaataagcaaaaatggcaaaataactcacgaactgttcgaggtcgtcctaccacgagttggccagaaaactctattcaaaaactcaaaatacaaccttttcctggtaaacagtgacacctatatgcacaactatcaggaactctggatgccccgggaataccagaaaatgtggaaagacatcagcctctcaaagtacggcgatgcccaaacagaggatcaactggaccaaatcttcgggttcatcgtatctcaagttaatagctacttcaacctctacgatatcaaccaattccggaaaaagctcaacgacgctgcggataaattcgcaaccctcccaatgcgcgacacagacgacatgcaggggaaaatagctacaatcggccagctcctaataggccttcaggcgaacgcggctcgatcggacctaaggaacctggacataaaaacgccactagggctcctacaaatcccgaacgggatcagtctggacagcgacacttccgtcgtctaccaaagcccaaccggactattagaacgcgaggtccacctttctgacctatga

SEQ ID NO: 6715 - RNA, 4170 nt, synthetic construct
  misc_feature 1..4170: note = Cas9 variant
  source 1..4170: mol_type = other RNA
atggcccgggactacagcgtaggccttgatatcggcaccagctcagtaggctgggcagcgatcgataacaaatatcacttaatccgggcaaagtccaagaacctcataggggtccggctgttcgacagcgcggtcaccgcggagaaaaggcgcgggtatcgcaccacacgaagacggctcagccgacgacactggagactacgcctcctaaacgacatcttcgccggccctctcaccgacttcggagacgaaaattttctggcccggctcaaatacagctgggtacacccccaggaccagtcaaaccaagcacacttcgccgcaggcctactcttcgacagcaaagagcaggacaaggacttctatcgaaaatacccgaccatataccacctacgcctagcgctcatgaacgacgaccaaaaacacgacctcagagaagtatatcttgccatccatcacctagtaaaatatcgcggacacttcctcatagaaggcgacgtgaaagccgactcagcatttgacgtccacacattcgccgacgccatccaacgatacgcagaatcaaacaacagcgacgaaaacctattgggaaaaatagacgaaaagaaactttccgcagctttaacagacaaacatggctctaaatcacaacgtgccgaaaccgcagaaacagcattcgacatcctagacctacaatccaagaaacaaatccaagccatactcaaatccgttgtaggcaaccaagccaatctgatggccattttcggcctcgattcttccgcaatatcaaaagacgaacagaaaaactataaattcagtttcgacgacgccgacatcgacgagaaaatcgcggacagtgaagccctactttccgacaccgagttcgaatttctctgcgacctgaaagcagctttcgacggcctcacactaaaaatgctcctaggcgacgacaaaactgtctcagcagccatggtccgccgattcaacgaacaccaaaaagactgggaatacataaaaagccacatccgcaacgctaaaaacgccggtaacggcctgtacgagaaaagcaaaaagtttgacggcattaacgccgcatatcttgcgctgcaatccgacaacgaagacgaccgcaaaaaggccaaaaagatatttcaggacgaaataagctccgcagacataccagacgacgtcaaagcggacttcttgaaaaagatagacgacgaccagtttctgccaatacagcggaccaaaaataacggaactatcccccaccaactccaccgaaacgaactcgaacaaataatcgagaaacaaggcatctattacccattcctaaaggacacctaccaagaaaattcccacgagctaaacaagatcacggccctcataaacttccgagtcccgtactacgtcggccctttagtcgaagaagaacagaaaatcgctgacgacggcaagaatattccagaccctacaaaccactggatggtccgaaaaagcaacgacaccattaccccctggaacctctcacaagtggtcgatctagacaaaagcggccggcggttcatcgaacgcctgacaggcaccgacacctacctcattggcgaacccaccctacccaaaaactctttactctaccagaaattcgacgtattgcaagaattgaacaacataagagtaagcgggcgccgactagacattcgcgccaaacaggacgctttcgaacatctcttcaaagtacagaaaactgtctcggccacaaacctcaaagacttcctcgtgcaagcaggatacatatcagaagacacccaaattgagggtctagcagacgtcaatggcaagaacttcaacaacgccctcacaacatacaactacctagtttcggtactcggcagagagttcgtagagaacccgtccaacgaggagctcctcgaggagattacagaactacaaaccgtctttgaagacaagaaagtactccgacgccaactagatcaactcgatggcctaagcgaccacaacagagaaaaactttcccggaaacactacaccgggtggggacgaatatcaaagaaactgcttaccacaaaaatcgtacaaaatgcagacaaaatcgacaaccagaccttcgacgtaccacgaatgaaccagagtataattgacactctgtacaatacaaaaatgaacctgatggaaataatcaacaacgctgaagacgacttcggcgtcagagcctggatcgacaaacagaatacgaccgatggagacgaacaagacgtatactcgctgatcgatgaactcgcagggcccaaagagattaaacggggcattgtccagtccttcagaatcctcgacgacatcacaaaagcggtaggatacgcaccaaaaagagtttatctagaatttgcccgcaaaacgcaagaaagccaccttacgaactcgcggaaaaatcaactatcgaccctcctcaagaatgctggtctgtctgagctagtaacacaggtaagccagtatgacgcagctgccctccaaaatgaccgcttatacctctacttcctccaacagggaaaggacatgtactccggagaaaagctcaacctcgacaacctctcgaactacgacatagatcatatcatacctcaagcatatactaaggacaattcgctcgacaaccgggtactcgtttcgaacatcaccaaccgcaggaaatcagattcctccaactacctcccggcactgatagacaaaatgcgtccattctggtcagtgctgtcgaaacaaggcctcttgtcgaaacacaaattcgccaacctcacgcgaaccagggacttcgacgacatggaaaaagaacgattcatcgctcgatcgctagtggaaacccgtcaaatcatcaaaaacgtcgcctcactcatagactcacactttggcggagaaaccaaagcggtcgcaataagatcctccttaacagccgacatgcggcggtacgtcgacataccgaaaaaccgcgacataaatgactaccaccacgccttcgacgcactcctgttctcaactgtaggtcagtatacggaaaactctggcctcatgaaaaagggccagctttccgatagcgcaggcaaccaatacaacagatacatcaaggaatggatccacgcagccaggctcaacgcgcagtcccagcgagtcaaccccttcggcttcgtcgtcggctcaatgcgcaacgccgcccccggcaagctaaatccagagaccggagagataacgcccgaggagaacgccgattggtcaatagcagatctcgactatcttcataaggtaatgaacttccgcaaaatcaccgtaacacgccgactaaaagaccaaaaaggacaactatacgacgaatcacgctacccctctgttctccacgacgccaagtccaaagcaagcatcaatttcgacaaacacaaaccggtagacctatacggcggattcagttcagctaaaccagcgtacgccgctttaatcaaattcaaaaataaattccgtctggtcaatgtcctccgacaatggacatactcggacaaaaattccgaggactacatcctcgagcagattaggggaaaataccccaaagcggaaatggtcttaagccacataccctatgggcaactcgtaaagaaagacggcgccctggtaaccatcagctccgcgacagaactacacaactttgaacaactatggctgccgctagccgactacaaactcattaacaccttactgaagacgaaggaagacaacctagttgacatcctccacaaccgccttgacctccctgaaatgacaatcgagtccgcattctacaaggccttcgacagcatcctttccttcgctttcaaccgctacgccctccaccaaaatgcactggtcaaactccaagcccaccgagatgatttcaacgctctcaactacgaagacaaacaacagacccttgagcggatcctagacgccctccacgcatcgccggcctccagcgacctcaaaaagattaacctatctagcggattcggccgtctcttctctcccagccatttcacacttgcagacacagacgagttcatattccaatcagtaacaggcctgttctcaacgcaaaagaccgtcgctcagctttaccaagaaaccaaatga

SEQ ID NO: 6716 - RNA, 4170 nt, synthetic construct
  misc_feature 1..4170: note = Cas9 variant
  source 1..4170: mol_type = other RNA
atgaaaaactacaacatctcattagtccccagtccctccggggtcgggtacgccgtcaccgacgacaaccttaacataataaagcccgtgcaccatgtctctggcatcggatcccggctgtttaacgaaggctcctcgaaacaagaccggcgtaactcgcgaagcgcacgccgctcccgacaccgccagcaagggcgcatcaaagcgctgaactccattatgaaagatgaaatcataaaggtcgaccccacgttcttcgaccggctgtaccaatccgaactcagccccctcgacaagaacaaaaagtaccggaacataattttcgacaaaccctcagtcgaaagctactattacaagaaatttcccaccatatatcatctggaaaaatacctcatcaatacagacggcaaagcagacatacgcctcatttactgggccctgcactccttactaacccaccggggccacttctacaacactaccccggtctcccagttcaaacccggcgccctaaacataaaagacaaattcatagaactcaaccaactcaaccaagtaaaaacattcgagttctcagtggccaacacaccagaaatcgaacacattctcaaagatagatacataagcaaacaaaataagattaaccaactcgcggaactcctctttgaacaagaaccggaaaaagacatacaaaaggccaataccaaggtagcaaagacgatagcgaaggccattctgggcaacaaatttcaactagacgaaataattggactcgatgtcaacaaatccgaaaagaaagaatggtctctccaactatccgatctcaacctcgactccaaaatcgacgaactaagcgactccttaaccgaccaacaactccggatcttggagatactacaagaaatgtacgccgcaacgaccctactcgacattttgcaagggtcggactcattgctagatgcaaaaatcaaatcatacaacgaatacaaacaaaaccgcctcttgttcttcgaccttctgaaaaccctccccgacaaaaaggcccatctgctgcgccagggctacaccctttacctcaacaaccaccaccgcgacctcgcatctgcccgcaaggacctgggaatagtggcggccacaaattttagcaaaacagacctctacgccctgatcaaaaagaccctcaaggacgagcccgaaaccccagaatccaagaaagtacttggcctcatagacaaaggcgagttcctaaataaacaacggacagacctcaacacctacatcccctaccaactcaacgcactgatcctaaacaaaatactcaaaaaccaggggaaacactacccgttcctaatcaaagaaaacccagccgaacccgaccgcaaagaagcaccgtacgaaatcagccaattgatgcaattcaccatcccatactactgtggaccactcgcaacgccagaggaacagaaaaacctaccagagtcctctagattcggatggctcgtccgcaaagaggaaggacgtataaccccttggaacttttacaacaaaataaacgtcatcgagaccgcaaacgccttcatcaaacgaagcatcggtaaagacacctaccttcttagcgaacccgtgctccctgacaacagcctactataccagaaatacaaagtcctcaatgaactgagctccatcagcttggtagatgcaaataccaagaaagagaagaaactcactgccaaaatcaaacaactgctatacaaagaaggatttaaaaagcacgttacagtgtcaaaaaccatggccctcaaaatcctaaatgacaacaacgtgccaacctcagacatcctcgggctctctaccggcaaaaagttcgacaactccctctctacgtataactcatggaagaaagcctttcccgaacaaatcgacaacccccactacagacaagacttggaatacatgatcgagtggtcaaccgtgttcacagacaggaaaatactcgtagagaaactaaaagaaatagagtggctccgccccgaacaaattaaattcgttctagaacaccggctaaccggatggggaaaactcagcaaacgactcctggtggaactcaaagacaacaaaggaaagagcaacatagacaacttattcaacaccaagaaaaacttcatgcaaatcgtaagccagcaggtatacaacacgcagatcgaagctatcgccctaaaaaccactaaaaaccaatcacttgataatatcctcgaagcagcctacacatccccagccaaccggaaggccattcgacaaacaatgaaggtcgtcaatgagatcgtaacactcgccggaaaaggcacacaccccgacaagatttttcttacctttcagcgatctaaagaacaagaaggcaagctcaccaccgaccgcgcatcctcgctcctcaagatctaccgtggaatcaaagatccactgtgcaccaaagagctcgtcgacgagctctccaaaaacgtgcgggcgaacctgatcaagaccaaggagtacttatactaccaacagctcggcagagacgccctgacaggcgaaatcatagacaaaaccgaccttagaaactacgcagtcctccacattatcccgcggtccgtggtagtcgacgactctataaacaacctggtcctcaccaaggtcaaaaacgccaaagagtccatagtcgtccaatacggctcgaaaaacatctccgacatctcgatgagcgtgaaagatttctggaacagactacaaaaactcggcctcttctcgaaaggcaaactcagaaacttaacaacagatctcaccgaacttaaccaatacgaaaaacaaggattcatcgcacgccagctcgtagaaaccaaccaaattgtcaaactgctcgcaacaatcctacaaggccagttcccccacaccaaaataatagaagtccgacaagaacagatagccaacatacgctaccaactcgacatctaccgactccgcgacctcaacgtatactaccgcggaatggacgcgtacctggccgcagttgtcggaacctatctctacaccgtttacccgaaggcgcgccgctttttcgtgtacggtaaataccttaaacaagacaaaaacaacagggaagaaggccaattcaagacgtctggacacagcttcaattttctatggaagctgttttatggaggggaggacgagatctatgtccaaggcaccaacaacatcgccttcaataaaaaggatctactacagaaaataaaagaagtgaacaactacaagttccaaaacgtctcactagccacagggaccaggcgatcagacctctttaagcagacaatctacccccggcaagaacgagacgttaaaaagtcacgaacattgattacaaagaaaaacggtctctttaccgacatctatggtggatacactggcaacgtcaactcgtacttcgtcctcgtccaaaccaaatataaaaaggaccccgacaaattcaacctctacggcgtgcccaaccgatacgtagctatgctcgaacaatccaaaagtaaaggcaactatgagactaaactgaaggaagttatggaacccatcatcaagaactcgaacaaacgcatgatcggctacaaaatcctaaaagatcgcatactatacaaccaaattatagaagataacggttacaaattcttcataacgtcctcccagtaccgccacaacttccgacaaatgatcctctcagaccaatccaagaaaatcttgatggactacgtcttcgaccccaacttttaccgacacaagaaaacagaggatgtgaacaacgataaagacgccaaactcataaaagtctatgacgaaatcctgtaccaaattgaccattacctacaaatattcactataggccaccatatcgacaaactcaaaaaggcccgcccccttttcgaaaaatgtacccttgcagaaaaggcacaagtcctgaacgacatactcatcattgccggctcaaaccaaaccgaactagcgctcaagcccctaaagaccaccaaactaactttcagcaaacaaaattgcccccttacaaaagatgcaatcttctactaccaatccccaacagggatgatcacccgaaaggaatctatcaaggacatcctcaaacaaaacatatga

SEQ ID NO: 6717 - RNA, 4173 nt, synthetic construct
  misc_feature 1..4173: note = Cas9 variant
  source 1..4173: mol_type = other RNA
atgtcaaggaaaaatatcgtcgaggattacgcaatcagcctagacatcggcaacgcatcagtcggctgggtcgcgttcaccccgaattacagattggttcgcgccaaaggacacgaactaataggtgcccgactgttcgagcccgcatccaccgctgaagaacggcgcatggcccgcaccacgcgacgaagatactccagacgcagatggcgcctcaggatgctagattccatgttcgaccaagcactctcggaagtcgacccgtcattcctcatgagacgaaagtacagctgggtccaccccgaagacaagaacaacgaagcacactggttcggaggtgtcctctttgacagcaacgaacaagacaagagattctacgaaaagtacccaacgatataccacctccgaaaaagcctcatggaagatgacgaacgccacgatatccgagaggtgtacctcgcaatccaccacatgatgaagtacagaggtaactttctcacggaaggcgaactagcccccagcagtgtattcgacgtagaagacttcctaaaactcttaaccgaaatcctccaatacgccgacgaaggcgaaaccgacgaagacctcgagctccaagccgatgcgaacggcctaaccgaagccctctgcactaccaaagggagtcgcagcatacgcgccaagaatgccatttcaatactcaaagagggagccgcactctcaaaaaggcaggaggcgataatatcagcggtgttcgcagggctagaaggtaacaagttagatctaaccaaagtattcccaaacaaagaatacaccccggaagacaagaaaaccctagccctttacttcaacaaagccgactacgacgaaaaacgcgtggccatcggagattcaggcctactcgaagacaacgaatgcgacttcctcgattgcatccgcaggcaatatagcgcaatagccctcaaacagctcttaggagatttcacgtccatatctgaaagcatgtgcgcaagatatgaacaacaccaaagaaattgggacctaatcaaacgatactgccgagaggagtccaacgccgagaatatcaacaaaaactacggcgccttagtcggatgggaaatagttgggggacaacgccgatcaatccgcggagccaaagattacgaaaacaaacgaaaagcagcgaacaagttctttgaggagctgatcaaagggtccgccttaccagaccaggagaaagaacgactactacacgacattgagaacgacgagctatttcccgtgcaacgagactcaggtaacggggtcattccgtaccaactccacctcaacgaactgaaaaagatcatacaaaagcagggacgatattatccattcctcctcgaaacctacataaaagacgggaaagaagtcaacaaattagaaggattactcgcgtttcgagtaccatactacgtcgggccactcgtcagccgtgacgacatgcaaagctccgacaaccgagaaaatcactggatgatcaggcgcaaaaagggtgtcataaccccttggaacttcgacgaaatggtcgacaaagacaaaagcgggcacgagttcatcaaatcactcgtggggaccgacagctacctcctcggcgaaaccacactcccgaaaaactccctcctctaccaagaatttgaggtcttaaacgaactgaacaacgtccgactctccatccgcacgggcaaccactgggcggacaaacggcgagtacgcctcggccataacgaaaagaaactgctactcgaagaactattcgcaaaacaagcgaccgttacgaagaaagccgccgagaacctcctacggaggacgtacggcaatacctatgaaatcagtggcctcgcagacgagaagaaattcgtttcctccctaagcagctacggaaaaatgtgcagaacgctcaaagcctcttatgtcaacagccacaaagacgtggtagagaaaatcatcgaactccagactgtcttcgaagacaaaaagacactcaagcaccagctacaactcctgggcgaactagcggaaaccaactgcgaactgctaagcaatacgcattacacggggtgggggaaactctccagaaaactcctcacaagcaaggtggttgtgtgtaagatcggcaacgacttcgcgccagctaagcacagcatcatcgaaataatgcgggaaacagatcggaactttatggaaataatcactgacaaggacctaggagtaggagaatggatcaaccaacaaaatgtaggggccgaggacggaaactcctaccaagacataatagacgacctaagggtatcaccaaaagttaagagaggcatcaaccaggcgatcagagttatcgacgatatctccaaagcagtaggaaaagaaccctcccgaatattcctcgaactcgccggcgacgtccagcaatcagcgaggacagtctcccgaaaaagccggctccagggcctctacaagtctgcgggcctccaaaaagagttcagggacctggccgaaagtctaaacgaatgctcggacaacgacctacgagacgaccgcctattcctgtactacacccagctaggcaaagacatgtacacaggagaaccactcaacctcgaccgactatcatccgactacgacatagatcatatcataccccaagcagtcacccaaaatgactcactcgacaaccgagtactggtcgcaagagttgcaaatgccagaaaaacggatagcttccaatacctaccagaaatcgctaaccgaatgcgtaacttctggcaagaactgctcgacgcaggcctaatatcaagagtgaaattcgatcgcctgaaccgccagaacgatttcagctcacacgaaaaggaaagatttgtacaacggagcctggtagaaacccgccaaataatgaaaaacgtagccacaataatgcgaaaacgttacggcaatagcgccgctgtaattggcctaaactcggaactaacgaaggagatgcgtcaatatctaggtttctcacacaaaaaccgcgacatcaacgactaccaccatgcccaagacgcattatgcctggggatagccggccaattcgccgtaaaccgcggattcttcgcgaacggaatggtgtcagacggagcggtaaactcatataacctctacctacaggactacctccgcggctaccgagagaaaatgtccgcaggcgaacgccgccgcaacaaagcgttcggtttcattgtcggcagcatgaactcacaggactcagacaagcgcatcaacccaaaaaccggtgaaatcgcatgggacgacgaggacaaagtctacctaaggaaggttatgaactaccggaagatgctgataacgcaaaaagtaggggacagcttcggcgccctatacaacgaaactcgctacggtacttccgctaaagagggggtcaacgggatacctttcgataaacataagcaagacacggccctatacggcggcttctcaagcgccaaaacagtctatgtcgttttaatcgaagcaaagaagaaaacccgtcttgtcaacataaccatgcaagagtacgcagagctgggagaccacccctcagacgacgcactaagagcagtactagccaagaagaaacccgaatacgggaaagcgcgcatcctgctgcgccatattccaccaatgcaactaatccgctacggaggggctctcgttaccgtcaaatccgccacagaactcaacaatgcccagcaactgtggctaccatacaaagaatactgcctgttcgacgatgtaatctcgagcgcgatcgacgtcgacgaagctaggctgtgccaaatgctagacgtaatactcgacgctatccaaaaatactaccccaaacagcggtttgacgaaacgggcctatcagcctttcacaacgcgttcaacgaagtaagcgcggaagataagaaacgaatagtaggggaaatggtcggcatgctccacgcagacgcgaaaaacgccaacctcaaagcattggggatgtccggccgatggggccgcatgagtaaccaaagcggctacacattcgccgattccgacgagttcatattccagagcccctccggactatttgaaaaacgcatatctgtcggggaactcaagaaacgacgcgcaagatga

SEQ ID NO: 6718 - RNA, 4173 nt, synthetic construct
  misc_feature 1..4173: note = Cas9 variant
  source 1..4173: mol_type = other RNA
atgaaggaagtgaaagactatatcatcggacttgacatcgggaccaactcttgcgggtacgtcgtcaccgacaaacaaaacaacatactaaaattaaaaggcaagaccgccataggagcgcgcctcttcaaagaaggagaagctgcagccgaccggcgagcgttccgcacaacccgacgtcgactggcccgcagacgctggcgactcggactcctagaggaaatcttcgacgaggagatggccaaagtcgacagctcattcttcagacgcctaaaagagtcggactacagcccaaaggacagccgcaaacagttcaacagtatagtattcgaatcctcggaagccgacaaagacttctacgacaaatacccaaccatctaccaccttcgaaacgcgctaatgcacgacgatcagaagcacgacttacgggaaatattcctggcggtccaccacatcgtaaaataccgaggcaacttcctccgcgaagattcagtaaaagcattcaaggccgccaaattcacgctacaaggtgaagacggcatcggacctgtcgacaagctcaatgacctactcaaagaaatttacattgaagcagcccctgaactagccaccgacaacctcagcaaaatcgaagagattatcaaggacaagaaactatacaaacaggacaaacttaaacaagtggcaaccctcctgacaaaagaagccgacacaaaagacaaagcaaaactaaacaaggacgtagccaagcaagtggcaaacgccttcatggggtacatgataatattcgacacaatcttcaatctctcggacgtagatagcaaagactacaaagttaagttctccgacgcaaacatagacgagaaactagacaccctaaccagcctactcaccgataaacaaacagagttcgtcctcgaactgcaaaatatctacaataccattgttctaaacgaaatcgtccctgatggaaaaagcctgtcagaaagcatggtaaagaaatacgacgaccacaaagaagaccttaaactattcaaagcgtacctcaactctttaacagatgtaaagaaagtgaaagaactgaaggcggcgtacgtcctctacgtaaacaaccgcaaagcaaaccttctcgctgccaaaaagctactaggaaagaaagcagataacatgaacaacttcgagatcttcagcaaattcgtggcagacaatctagacgacagcgaactagcaaacaagatcagagccaggcttgacctcggcgagttcctgcccaaacagcgcactaaccaaaacggcgtcataccctaccaactgcaccaagtagagctaacacaaatcctcgagaaacaaggtaagtactatccattcctaatcgcaccgaacccagtagaatcgcaccgtaacaacgcgccataccgaatcagcgaactggtgagcttccgcgtgccatactacgtaggaccgctaatcgatccgaacaacgcagagtcagaacaagacaaggccaattccagctttgcgtggatggtgagacagaaacaggggcagatcacgccatggaacttcgaagaaatggtcgacacaacagaaagcgccaacaagttcataaaacgaatgacaacaaaggacacatacctcttgggggaggacgtcctgccagcgtccagcctaatctaccaaaaattcgtgatactcaacgaactcaacaatataaaagtcaacggtataaaactcacctcagaagaaaaacaccagatcttcgacgagctgttcaaagtacaaaaatccgtaagcctgaaaaatctagtcaacttcctaacagctcacggctgcgtggcaccgaatgtaaccgggctcagcgacggcacaaagttcaacagctcctactccacttacatagactaccggaaaatcttcggcgccgaaatcgacaacaaagacaaacaagcagacttcgagaaaatgatcgaatggtccactgtgtttgaagaccgaaagatttttaaacgaaaactggaagaaatcacatggctcacacccgaccagatcaaacaagtaagctcgaaacgctacagcggatggggacgactctctaagaaactcttaacccaaatcaccgacgaaaacggggtaaatatcctacaacgcctatggaacgaatccgagaatctcatgcaaatcctaagtgaccccgtcatcaaagagaaaatcgtcgccgccaacagctcattcaccaaagcaaccgacatggaagacatactcgcagaagcatacaccagcccccaaaacaagaaagccatacgccaagttatgcgcgtagtcgacgacataatcgccgcggcccacggcaagaaacccagtcaaattgcaatcgaatttgcgcgggaggaccaagacaacccccaaatgactaaatcacgcaaagcccagctcgatcaaatttacgcaaaaatctcagacgagttccttgataatgcggttaaaaatgaactcaaaaatatgaaagacaacaaacccctagccaaagacaaagtatttctctacttcaaacagatgggccgagacgcctataccggtgagaaactgagcctcgacaacttacaagattacgacatcgaccacatctacccgcagagcttcatcaaagacgacagcttcgacaaccgcgtccttgtccaacgtgcagtcaacaacggaaagtcggacaacgtgccagtcctcctgttcggaaacaaacaagccgccgacctaggcatgacgatacgtcaaatgtggaagaaatggctagagcttggcttaataagcaaacgaaagttcaacaatctaataaccgatccggagaaaatctcctcctacatggcatcaggcttcgtcaacagacagctagtggaaacaagccaagtgataaaacttgtcgcaaacatcttacaagcaaaactacccgacaccgaaataattgaagtgaaagcctcgtacaacagtatcctccggaaggagttcaacctttataagtcacgagaagtcaacgactaccaccacgcgattgacgcctacctcacgaccatcgtcggcaattacctataccaggtgtaccccaaactacgtccatacttcgtctacggacaattcaagaaattcggaaaagccgaatcgaaagaagacgatccggtcaagaaaataaaacagttcaacttcatatatcaactactatggggaaaagacgacgcgatctgcatctcacataccgatcaacaagtcttctcacgaagcgacatcatcaacaaactaacgaccgcgtacaattttaaatacatgaatgtaagtcaagaagtctacacaaactccaataacgtattcaaacagacggtattcccaatcatagaacgtgacaccgccaaaagccggagccttattcccaagaaactcgatcggcccacggacatctacggaggctactcgaacaacaatgacgcatacctcgcgctcgtcaaagtcgacaagaagaaaggcagcgaataccgagtggtgggtattcccatgcgcgcggccgcaatgctcaaagccagtaaaaactacgacgaggacctgcgaaaagtaatcgagcccatggtcatgctcgacaaaaacggaaaagccaaacggggaatagaaggattccgagtgctcgtcggcaaaatgccattcaaacaagccgtcctagacggagacaagaaatttatgctcaccggcaccaatgacatgcccaacctcaaacaactcgtcctatcccaacaaaatatgaagtatattctcgactacatagatgacatagactgccggaaacacaaattcggaaacaagacacaggatggcaacaagtgcctcctagaggtctttgatgaaattatccaaatagtcgataagcacttcgagcttttcgacaaccgctcattcagagagaagctccgtaactcgcgcgtcaactttataaacctagcactcagcaagaaagccgaggcactcctcgcaatattaaacggcctacacgcaaacagcatgcgcactaccattaaagaactgaaaatctcagacctcggacgcatacagagcagtgtcatctccccagaagcccagcttatctatcagagccccacaggcctgttcgaacgccgcgtcaaagtcaaagatctgtga

SEQ ID NO: 6719 - RNA, 4176 nt, synthetic construct
  misc_feature 1..4176: note = Cas9 variant
  source 1..4176: mol_type = other RNA
atggaaaataaacaatattacattgggctagacgtcgggaccaacagcgtcgggtgggccgtcaccgacacgagttataacctactgagggccaaagggaaggacatgtggggcgcacgattgttcgagaaggcaaacaccgccgccgagcgcagaaccaaacgtacctcccggcgaaggagcgagcgagagaaggcacggaaagctatgctcaaagaactattcgccgacgaaatcaacagagtcgacccctccttcttcataagactggaggaatcaaagttcttccttgacgaccgctcggagaacaaccgccaacggtacaccctcttcaacgacgccaccttcacggacaaggactactacgaaaaatacaaaacgatcttccacctccgtagtgccctgattaactcggacgaaaaattcgacgtacgccttgtgttcctggcaatcctaaacctcttctcacaccggggacactttctaaacgcaagcctaaaaggcgacggggacatacaaggaatggacgttttctacaacgacctggtcgaatcgtgcgaatactttgagatagaactaccacgcataaccaacatcgacaacttcgagaaaatactgtcacagaaaggcaaaagcaggactaagatcctagaagaactgtcggaggaactctcaatctcgaagaaagacaagagcaaatacaacctgatcaaacttatctcaggcctagaagcctccgtagtcgaactctacaacatcgaagacatccaggacgaaaacaagaaaataaaaataggctttcgggaaagcgactatgaagaaagcagcctgaaggtcaaagagataataggcgacgagtacttcgatcttgtagagcgggcaaaatccgtccacgatatgggcctcctttcgaacatcatcgggaactccaagtacctctgcgaggccagggtcgaggcgtacgagaaccaccacaaagacctcctgaaaataaaagaactattgaaaaagtacgacaagaaagcctacaacgacatgtttcgcaaaatgaccgacaagaactactcggcgtacgtcggctccgtcaactccaacatagcaaaagagcgacgctcggtggacaaacggaaaatcgaggatctatacaagtatatcgaggacacggccctcaaaaacatccccgatgacaataaggacaagatcgaaatcttagaaaagataaaactcggagagttcctcaaaaagcagctcacggcgtccaatggcgtcataccgaaccagttacagtcccgagagctaagggcaatcctaaagaaagccgaaaactatctaccgttcctaaaagaaaaaggggagaaaaacctcacggtcagcgaaatgattatccaactatttgagttccagataccgtactacgtaggacccctcgacaagaaccccaagaaggacaacaaggccaacagctgggccaaaataaagcagggaggacgcatcctcccatggaacttcgaagacaaggtcgacgtaaagggtagccgaaaggagttcatcgagaaaatggtacggaagtgcacatacatctctgacgaacataccctccccaagcaatcgctgctctatgaaaaattcatggtcctcaatgaaataaacaacattaagatcgacggagagaaaataagcgtcgaagcgaaacagaaaatctataacgacctcttcgtaaaagggaaaaaggtgtcacaaaaggacattaagaaagaactgatcagcctaaacatcatggataaagactcagtcctttctggaaccgacaccgtatgcaacgcgtatctgtctagcatagggaagttcacaggcgtgttcaaagaagagataaataaacaatcgatcgtagatatgattgaagacataatctttcttaaaacagtctacggagacgaaaaacgcttcgtcaaagaggagatcgtagagaaatacggggatgagatcgacaaagacaaaatcaagcgtattctcggcttcaaattctccaactgggggaacctaagcaagtcgttcctagagctcgagggcgcggacgtgggcacgggcgaggtccgatcgatcatacaatctctgtgggaaacaaactttaacctaatggaactcctcagctcacgcttcacctacatggacgaactagagaagcgtgtaaagaaacttgaaaagccgctatcagagtggacaatagaggacctagatgacatgtacctatcaagccctgtaaaacgcatgatatggcagtcaatgaaaatcgtggacgaaatccagacagtcataggatacgcaccgaaacgcatcttcgtcgaaatgacccgttcggaaggagaaaaagtgcggaccaaatcccggaaagatagactgaaggaactgtacaacgggatcaaggaagatagcaagcagtgggtgaaagaactagacagcaaagacgaaagctactttcgaagcaagaaaatgtacctgtactatctccaaaaaggaaggtgcatgtactcaggagaagtgatagagctcgacaaacttatggacgacaacctgtatgacattgaccacatctaccctcggagcttcgtaaaagacgacagtctagacaatcttgtactcgtgaagaaagagataaacaaccggaaacagaacgacccaatcacgccccaaatccaagcgagctgccaaggattctggaaaatcctccacgaccagggattcatgagtaatgaaaaatacagccggctcaccaggaagacccaggagttcagcgacgaagaaaagctgtctttcataaaccgacaaatagttgaaacggggcaggcaacaaagtgcatggcccaaatactgcagaaaagcatgggcgaagatgtcgacgtcgtcttcagcaaggcccgcctagtaagcgagttccggcacaagttcgaactgttcaagagcaggctcatcaatgatttccaccacgcaaacgacgcatacctcaacatagtagtagggaactcgtacttcgtgaaattcacccgcaaccccgccaacttcattaaagacgcaaggaagaaccccgataaccccgtatacaagtaccacatggacaggttcttcgaaagagacgtcaaatccaaaagcgaagtcgcatggattgggcaatcagaagggaatagcggcactatcgtaatcgtgaaaaagaccatggcaaagaactcgcccctgatcacaaagaaagtagaagaaggccacggatccataaccaaagaaacaatcgtaggcgtcaaagaaatcaaattcggccgcaacaaagtcgagaaagccgacaaaaccccgaagaaacccaacctccaagcgtaccgacccataaaaacatctgacgaaaggctgtgcaacattttacgatacgggggcaggacatcaataagcataagcgggtattgcctcgtagagtacgtcaaaaagcgtaaaaccatacgatccctcgaagccataccagtatacctgggacgcaaagacagtctcagcgaagaaaagctactaaactacttccgatacaacctaaacgacggagggaaggactcagtaagtgacatccgactatgcctaccgttcatttcaacaaactcactggtgaaaatcgatgggtacctatactacctcggcggcaaaaatgacgaccgaatccaactgtataatgcctaccagcttaaaatgaagaaagaggaagtggagtacatcagaaaaatcgagaaggccgtttcaatgagcaagttcgacgagatcgaccgcgagaaaaatcccgtcctcacggaagagaaaaatatagaactatacaataagatccaagacaaatttgaaaacacagtctttagcaagagaatgagcctcgtgaagtacaataagaaagacttatcgttcggtgacttcctcaaaaacaagaaaagcaaattcgaagaaatcgacctagaaaagcagtgtaaggtgctgtacaacatcatattcaacctctcgaacctaaaagaagtagatctgtccgatatcgggggaagcaagtccaccgggaagtgccgatgcaagaaaaacatcaccaactataaagagttcaaactgatacaacagtccattacggggctatacagctgtgaaaaggacctcatgaccatatga

SEQ ID NO: 6720 - RNA, 4176 nt, synthetic construct
  misc_feature 1..4176: note = Cas9 variant
  source 1..4176: mol_type = other RNA
atgaaggaaattaaagactacatcatcggactcgacatcggcaccaacagttgcggctacgtcgtcacagacaagcaaaacaacatcctcaaactgaaaggcaaaacagctatcggagcccgcttgttcaaggaaggggaggccgccgcagatagacgcgccttcagaaccacccggaggcgactcgcccgtcgccgctggcgcctctcattgctggaagaaatcttcgacgaggagatgaacaaggtggacccatcattctttcgccgactcaaagaaagcgactacagcccaaaagacaggcgaaaacagtttaattccattgtatttgaaagctcggaggccgacaaggcattttatgaaaagtaccccaccatttaccacctacgaaacgcccttatgcacgacaaccaaaagcacgacctacgcgagatattcctggccgtacaccatattgtaaagtaccgaggcaactttctgcgagaggacagcgtcaaagccttcaaggctgcaaaatttacgctccagggcgaagacggaatcggccccgtagacaaactcaacgacctcctcaaagaaatatacatcgaggctgcccccgagcttgcgacggacaacttatcaaagatcgaagacataatcaaagacaagaaactctacaaacaagacaaactcaagcaaatcgccaatctactccccaaagccgtcgacagtaaggacaaggccaaactgaacaaagatatagccaaacaggtcgcgaatgcgctgatgggttacatgttccgcctcgacaccttatttagcttcaccgacgtggacgtgaaggactacaagctgaaattctcagacgccaacattgacgagtccctagacgctttaacatcgttactaaccgacgcacaaatcgagttcgtccttgaactacagtcgatctataacacgatcgtactgaacgaaatcgtcccggacggaatgtccttatccgaatcaatggtaaagaaatacgatgaccacaaaaaggacctcaaactctacaaagaatacatagactccctatccgaccaaaagaaagccaaacaactagaggcagcctacgcactctacgtcaactaccgtaaggcagacctactcgcagcaaagaaattgttcgaaaagaagaagatcggagacaaaaagttcgtcgacgtaatatcaaactttgaagtcttcggcaagttcgtatccgacaacctagacgactccgaactcgcgaacaaaatcaaggcacgtttggacctaggtgaatttctgcctaagcaacgaaccaaccaaaacggggttataccctaccaacttcaccaagtcgagctgacacaaatcctagagaaacagggcaaatactaccccttcctgatcacacctaaccccgtagaatcccaccgcaacaacgcaccctatgaaatatcggaactcgtctccttccgcgttccctactacgtcggccccctaatagataaccaatccatcaaagacaaacaaaataaaaacaaattcgcatggatggtcagacaaaaacaaggccaaataacgccttggaactttgaagagatggtcgacactaccgaatccgcgaaccagttcatcaaaagaatgacccgaaaggacacttatctcctcgctgaagacgtactccctaaatcctcacttatttaccagaaattcatgatactggacgaactaaaccgtataaagatcgacggaaagaaactgacgtcaaaattaaaacacgacatcttcgagaagttattcaagaaacaaaagtccataaacctcgacaatttgaaaaactacctactagcagaaggtaatatacccggactcattgaggggctctccgacggcatcaacttcaacaactcgtttagcacctacatagattaccgcaacatcttcggggacgagattgacaacccgaacaaacaagccgacttcgagaagatgatagagtggtcaacggtcttcgaggaccgcaaaatattcaaacgcaaactaaaagaaataacctggctgacccctgaacaaattaaacaggtcagttccaagcgctactcgggatgggggcgcctatccaagaaactgctaacccaaataaccgacgagaacggtgtaaacatactccaacgactctggaacgagccggagacactaacagaggtgctggccaacccagtaattaaacgcaaaatatcagaagcaaatagcctattcgtacagatcaataaggtcgagaacatccttgacgacgcctacactagcccccaaaacaagaaagctattcgccaagtcatccgtgtagtcgacgacatcattgcagccgcgcacggcaaaaagccatcacaaattgcaatcgaatttgcacgatcgagccaaaacaaggcgaaggtcccagacacacgcaaaaagcaactggacaaaatctacaacaaaatcagctccgaaatcctagacagctcgatcaaaaatgagctcaagaacctaaaaagcaacaagtacttgtccaaagacaaactcttcctatacttcaagcaaatgggacgagacgcttacaccggagacaaattgtctttagaccagctccaaaactatgacatcgaccacatattcccccgcagtttcatcaaagacgattcccttgacaaccgtgtattaacacaaaagcccataaacgctaaaaagagcgactatggaatcccagccctggagttcggcaataaatacgtcccagacctgggtataaccgttaaagaaatgtggaaactttggcaggaaaacgggctaatctccaaaagcaaactcatcaacctctgcacgaaccccaagaagatcggatccaaaagagcctctgggttcatcaatcgccagctagtcgaaacctcccaagtcatcaagctagtcgccattattctgcaggcagagttccctgacacagaaataatagaagtcaaggccctccaaaacacaactctacgcgaatcatttcacctctacaaaaaccgctcagtgaatgactaccaccatgccatcgacgcttacctcacgacaatcgtcggtaactacctataccaagtgtacccaaagctgcgcccttatttcgtatacgggcagttcaagaaattcaatcaggagaaaaatatcgacattctcaaaagactcaaaaatttcaacttcctacgacaacttatatttaacacggacgacaacatatacatctccggtaccaaggaaatagtattcaacaagaaggatatcatacataaactagagaccgcatacggctacaaatatatgaacatttcgcgcgagtgttaccaagagaccagcagcctcttcaaccaaactctctacgctcacaactccagcgtcaaaaactccctgatccccaagaagaaaggcctccccaccgagatctacggcggatactcgggcaataaagactccttcttcgtcctcgtcaaaatcgtcaagaaacgcaccaacctctaccgcatagtcgggatacctactcgcgaactcgccaaactgaactcatccaacaactacaaccaagccctaaacaaaatcgtcgaaagtaaactctgcctgaaagaaacagaaagtttcaaaattctaatcaaacgtctcctctacgggaccctgatagtggacaatggccaaaaattccggataggcagcttcaaagaaaaacataacgtccaacaactcgtccttcaactcaaatcgatgaaatacataaaattttacatcgacggagggcaaaactatttcaccgacgtcgaacgcaaaaagctggaaaaacaagaccgcgataaatgcctactgtacgtcttcgacgacatcatgaacgtcgttaacaaacgcttcactctcttcgacatgtcgaaatacgaaaaagacggcgatagtctccgcgaaaaattcaactgcctagacttcaacgacaaagtctcgatactctccgatctactcaaagcattccacgcgaactccgaccgcacgtccatcactaagctcaaaatcactaacttgggacgtcaccaagccgggaagaacggcattaccctcacgactaacgcccagatcatataccaatcaccaaccggtctattcgaacgtcgaatcaaaatcaaggacctctga

SEQ ID NO: 6721 - RNA, 4176 nt, synthetic construct
  misc_feature 1..4176: note = Cas9 variant
  source 1..4176: mol_type = other RNA
atgaaaaagatcctaggccttgacctagggacaaactccattggctgggcactggtcaacgaagcagaacacgagcacgaacaatcgagcatcgtcaaactaggagtccgcgtcaacccattatccgtcgacgaaaagaccaacttcgagaagggccgccccctctccatcaatgccgaccgcacctcgaagcgatctgcacgacgaaacttgcagcgcttcaaactacgacggaaaaacctgataaatctgctcctaaaacaccacatcatatccaacgagacaatcctcactgaagtcggtaaaaacaccacccaccaaaccctaaaactacgctccaaagccacacaagagaagatatcactcgaggagttcgcacgcatcctactgtccatcaacaaaaagcgcggatacaaatcgtcacgaaaggaaaagaacgaagatgaaggattcaccatagacgggatggcaatcgcgaaggaactctacgacaatcagctcacgccgggccaatacgtgtacaacatcttacaggatggcaaaaattacatccctgatttttaccgttccgatctacaggcagagttcgatgacgtatggcaattccagaagaaattctactcctcgatcttgacggacgagttctatctcaaacttaaagggcaggggaaagaaaacacccgcaaacttttcctcgcgatccaccaagtttacacagccgaaaataagggcaagcgagacgccgtgaaactacaatactacaaatggagaagtgaagccgttaagaagcaactctccatcgaagaagtcgcctacgtgctcgtagaaatcaacaacaacatcaacaaaagctcgggatacctcggggctatctccgatcgtagtaaagccctctatttcaacaacgaaacagtaggcgagtatctatacggccaactcgtcaaaaaccgccacaactcattacgcaaccaagtattctaccgccaggactacctcgacgagtttgagaagatctgggaaacccaggcaaagttctacgacgagctaacaaacgagctaaaacaagaaatccgggacgtcgtgattttctaccagcgcaagctgaaaagccaaaagcatctgatctccgattgcctatttgaaaaacaccataaagccattcccaagagctctccgctattccaggaatttaaaatatggcaaaatctcaactacctagagttcgtgcacacacagtcgaaggagaaaattttcttctccgaactggacgacgagacccgtcagtttgtattcgcagaactaaacatccggggcacccttaagataaaggagatcaagaaactaataggcctggaaacaccagtctactggaaatccaacttcgacgaaatagaagggaatcggaccaaccaggtactctacaacgtataccaaaacatcgctgacgacctcggatacggatttgactggtccaagaaacacgccttcgagatcaacgcagaactacaggccatatttaaagacgttggcatcgacacagccatactcaacttcgacgcaagcatcgaggagaacgacttcgacaaacaaaaatcctaccaactctggcacctactatactccgcagaggacaccgataaagccaccgaggaagataaactcatttacgggaatatcaacacaaaactcaagaaacagctacaccagaaatacgggtttgaggcaaaatacggaaacctcctcgcgaatatcagtctccaacaggactacggcaacctgagcgccaaagccatcaagaaaatcctgccctacctagaatcaggtaactcgttctacgaggcttgcacgatagtcggttacaacccctccaactcgctcaccaaagagcaacaacaaaatcgcaaactgaaagacaaacttgaactgctgcccaaaaacagcctcagaaacccggttgtagaaaagatcctaaaccagaaggtaaacttaatcaaccaactaatcgacgaatatggcaaaccggatgaagtgcgcatagaactcgcccgcgaacttaagaaaagtgccaaacagcgcgccgacctcagtaaacacataaacgacgcaaccctcaaaaaccaaaacattcgaaaaactctacaaaaagactttggcatccaaaacccaagcaaaaacgacgtaatccggtacaagctctacgacgaactaaaagacaatggctataagacacttttcacaaacaaatacatccccaaagagcaactcttttcaaaagacgttgatatagaacatatcatccccaaagcaatcctctttgacgattcattttccaacaagaccttggcataccgaaatgttaatctcgcaaaggccgatgcgacagcgttcgactttatctcgtccaagcacctcgacgacctggacaactacaaggcccgcgtcgaaaccctattccaaagtaaacgcatctccaaaggaaagtacaagaaacttctcatgacccgccaaaacctccctgaagacttcatagaaagagacctacgaaactcccaatacatagctaaaaaggcaactgcgatgctgaaagaggtattcaggtccgtagtcccgacctcaggccgaataaccgacaaactacgcgaagactgggacctcgtcaacgtcatgaaagagctcaacctccccaaataccgaaccctcggcctaactgagttcatcgaacgaaagaacggcaacaagatcgaacagataatagactggactaagaggaacgaccaccgacaccatgcaatggacgctctgacagtcgccttcacaacccacaatcacatacagtacctcaacaacctaaacgtcacacacgggctcaacggagtggacaccgaccacgaaaagagccgactctacgcaatcaagcaagcgatcacaaaagtatacatagtgggcaagaccaagaagcgaaaattcatcccgccgatggaaaacttccgatcacacgcgaaaaatcacctcgaagggatacttatttccttcaaaaacaaaaacaaggttgtcacaaagaacaaaaatcggaccaaaacaaaaaccaaaggcgtgttcaacgagaaaatacagctaacacctagaggccaactgcacaaagaaaccatatacggacacgcaaagaaggtcatcgtcaccaaggaaaaagtatcctccaagttcacccacgagaaaatcctccaggtcacaaaacccgcataccgagaagcactcctaaagcgcctcgcctcctttaaaaacgatccaaagaaagcattctcaggcaaaaacgccctttccaaaaacccgctatactttgacatcacctccggaaagaaagtcccagacactgttaaactctcctacttcgaaaattcctacgtaatccggaaagaagtaaactcagacaacttcaaaaacgaaaaatcactccaaaaggtactcgacgttggtatacgacgtatactcgagaaacgactagcagactacaacggtaacgccaaagaggcattctcaaacctagagaaaaatccaatttggaaagacaaggaaaagggcgtttgcatcaaaaaggtcagaatagaagcactcaaaaacgcggaaccactccacgtcaagaaagaccatttaggcaaaatcatacttgacgacgaaaacaaatccacccccgtcgacttcatcagcaccggcaacaaccaccacgtggcgatctacgaagataaagacggcaaactccatgacaaagtggtgtcgttctacgaagtagtctcgagagtgaacctaggattacccatcatcgataaatcgttcaactcacacctcgactggaaattcctcttcagcatgaaacagaacgagatgttcgtcttcccctccgaagactttaacccgaaggagatcgacatcggcaaccccaaaaacaacgagctgatttcaaagtacctcttcagggtacagaaattttcaaaggtaacctacggaaacagcgcagttcgagactatgtcttccgccatcacctcgagacagaattgatagacaagaaggaactcaaaggaataacctactatcaattaaagtcgataggaatgctcgagaaactcgtgaaagtacgtatcaatcacataggcaaaatagtccacatcggcgagtattga

SEQ ID NO: 6722 - RNA, 4176 nt, synthetic construct
  misc_feature 1..4176: note = Cas9 variant
  source 1..4176: mol_type = other RNA
atgaaaacaattctgggcctggacctcgggaccaacagcatcggttgggcactcgttaaagaagcggaaaacgaaaacgaggtatcggacataatcaaactcggcgtccgggtgaaccccctaaccgtagacgagctcaccaacttcgagggaggcaaagcctacagcaacaacgccgagcgaacactgaaacgaggcgctcggcgcaaccttcaacgctataagctgcgccgagagaacctcatagaaatactactcaaaaacggcctcataaataaagacaccgcgctcaccgaagtcggcaaagaaacaacacatcaaaccctaaaactgagatccaaaagtgccaacgagaaggtcagtttagaggacctggccaagatcctcttgtcgatcaacaagaaacgaggctataaatcgtcacgaaaagtgaacgccgaggatgatggggtcgccatcgacgggatggaggtggccaaactgctctacgacgaaaacatgactcccggggaatacgtactacggctactcgagtcgggaaagaaacaccttcccgacttttaccggtctgacctccaagaagagttcaacctggtttggaagaaacaaagcgagttttacccgctcatactcacaaaagagctgttcttcgaacttcacgggaaaaacaagtcgcagacttgggcaatctgcaaggaacccctcggcattgttggcgtaaaactcaaagggtccgccaaagaacagaaattcgcccgctacaggctccgcaaagaggccctaacccaacagatcgaattggagcacctcgcgattgtactccaagacataaacaacgacagcaacaagtcctcaggctatctaggggcaatctccgaccgaagcaaagaactcttcttcaacaaagagaccgtcggacaataccagtacaagcagctgcagaaagaccccaacacgtccctaaagaaccaagtattctaccgccaagattatctagacgagttcgaagtaatctggagaaaccaggcgaagttctacccgcagctaaccaacgaactgaaacaggaaatccgcgacgtcgtaatattctaccagcgcaaactcaaatcccagaaaaacctcatcagtttttgccaattcgagagcacccagcagaactacgtcgaaaaagagaccggcaaaaccaaaatccgcacgattggacgtcgggtcatacctagatcatcgcccctcttccaagagttcaaaatctggcagagcctaaacaatctcaagttcgtcaattccgagtcaaaccaaataatccaattcatagagctcgaagacgacgtgaagaaggtggtatttgacgagcttaacctaaggggcgaccttaaaccaaaccaggtcctcaaaatcctcagcaagtacatgaagatcggcaaactcacccagtggaaatgcaaccttgaagaaatcgagggcaatcgcacaaacagcgcactatacaacgtcttccaaatgatagccgaagaggaaggatacggtttcaactgggggaagaaatccgcattagagatcaaatcggaactgaaggccatattctctagcattggaataaacgacagcatcctcgacttcgacttttccaagaagctagaccagcaactctcctaccaactctggcacctcctatactccgccgaagagggcaacagcaaaataacagaagaagacaaattcacctacggcaacacgggggtcgcactcaaaaagaaactacaccttaagttcggattcaagccagaatacagcacactaatcagcaacctaaggttcacctccgactacggaaacctgtcctcaaaagccatatcaaagatactccccttcctacgcgatggcagtgactattcaaaagcatgccaatacgctggatacaaccactccaactcgctctccgcggacgagctggacaaccgcgaactcaagccgaagttagaactactcaaaaagaactcgctacggaaccccgtggtggaaaagatcctaaatcaaatggttaacgtagtcaaccaagtgatagacaactacgggaaaccggacgaggtccgaatagaactagcccgcgaactgaagaaaagtgctaaagaaaggagtcaaatgacaaagaacatcagcgacgcaacccgccgtaatgcggaaatcaaaaagtacctctccaaagagttcggcattccaaaccccaccaaaggggacgtcatcaggtacagactatgggaggaactcgcgtcgaacggctataaagatctcttcagggacaagtacatccccaaagaaaaactgttctccaacgaaatagacatcgaacatataatacccaaggccctcctgttcgacgactcgttctcgaacaaaaccctagcgttcaaggtagacaacctcaagaaagccgacagaacagcgttcgacttcatgtccacggacttttccaaagacgtagactcttacatagggcgaatcgaaaccctccacaaagacgggaagatctcctctagtaaatacaagaaactcatgatccccaaaagcaaactggtcgacgggttcatcgaacgagacctccgcaacactcagtacattgcaaagcaagcccgcaagatgctcttagaagttttcaaaacggttgtacctaccacaggtaaaataaccgacaaattgcgcgaggactgggacctgataaatgtaatgaaagagctcaatttcccaaaatacaaagcgctcgggctcactaagaaaatagaaagattcgacgtcggctcagagaagatcaagtccattaacgtcatcgaaggttggagcaagcgaaacgaccaccggcaccacgcaatggatgctttagcagtagcattcacgacgcacaaccacatacagtatctgaactacctaaacgcacggaaggacatacatcacgaaatgcatggaacaataaagtccatagagaaccaaatcattggcaaggacgtaatgggaaaacgacgcttcatacctcccattagtgacctccgcatgaaggcaaaactacagatcgagtccatactcatctcgttcaaaaacaaaaacaaagtagttacttggagcgtaaacaaaacaaaactgaagggcaaagacaactacaataagcgccgacagctaacaccccgcggacagctacacaaagaaaccgtctacggcaagataaagttaattgaccccaaaccgctaaaactaaacaacaagttcaccctcgtaagagctagcatgatcgtggacaaagtccaccgagaaatagtactccagcacctaagcaaatacgacaacaacagcgaagtagccttcgactcaaaaacgataaaaatcgatccaatcctcatcgaaggaatcggactaaaagaggtcgtctgctacgaggatgtcttcaaaatccgaaagaaaatatcaggcgacaacttcaaaaacgagaagcacctagaaaaggtaattgacgagaaagtcaaacagatattgaaggaccgagtaatcaaattccaaggaaacttcaaggaggcgttctccaacttggaggaaaaccccatatggcttaacaaaagcaaagggatagcggtcaaatcggtagcgatcaagggagttaacaacgccgaatccctacacgagggcaaggaccatttcggggaccagatactcgacaagaacaagaaacaaatcccagttgactttgtgtccaccggcaacaaccaccacgtaggcatatacgaagacaaagacggaaacctgcaggaacgggtcgtgagctttttcgaagcggtaacccgagtcaacgaaggcctgcccatcatcgacaaaacctacaacagtgatatcggatggaagtttaaattcacgatgaaacagaacgaaatgttcgtgttcccgagtgacgacttcgatcccaacgagttcgacctgacagacgggaaaaacgccgccaagatctccccgaacctttacagggtccagaagatcgcaacaaagaactacatgttccgtcaccacctagaaacagtggttaccaacgacctggagttcacttacaagtcaatacgcagtacaggatggcttcgaaacctcgttaaagtccgcataaaccacctcggcgaaatcgtatatgtcggagaatactga

SEQ ID NO: 6723 - RNA, 4176 nt, synthetic construct
  misc_feature 1..4176: note = Cas9 variant
  source 1..4176: mol_type = other RNA
atgaaaaagatactcggcctcgacctcggcacgacctcaataggctgggcacttgttaacgaaaaggaaaataacgaggaactctcatcgataatacggctcggagttcgcgtaaaccccctaaccgtcgacgagaagtccaatttcgaaaaaggcaaagacatcacaactaacgcggacagaacaaaatgccgcagcgcacgacgcaacctccagaggtttaaactgagacgtgaagcactggcagactgccttaaacgacatggactaatgaccgacgagacgcccctctgtgaaacgaacaactcaatcatcttcaagacctactccaaccgcgctaaggcagtatgcgaaaagatcgcgctcgacgacttcgtcagggtcctcttcatgataaacaagaaacgcggttacaaatcaagtcggaaactaaacacagacgacgaaggcactctggtagacggcatggacgtcgcaaaactcttatacaacgaacagattacccctggcgaataccttcttcggcttttcaaaaaggggaagaaaacccgaccagacttctacctatctgacctaaaagcagagctcgagcgcatatgggacttccagcgaaccttctacccggaaatcctctgcaatgcattaaaagaagaccttaagggcaaaagccggacgcaatcctcggcaatattttacgcaaagtacaaagtgagcaccgccaagatcgcggggaaggacaaacgcctgcaagagctcacatggcgcaccgacgccctacgaaagcaactcaccatcgacgaagtagcatacgtaatctgcagcataaacggagaggtaaacggatcctcccaaagactctccatgatatccgaccgaagcaagctgctctacttcaaccaccaaacgatcgggcagtatctcatgcaacgactcgaagaaaaccccaacgctggcctcaaaaacatcatattctaccgacaagactacgaagatgaatttaatgatatctggaactcccaagctacctaccacaaagaacttaccccggagctcaagaaggaggtcaaagacataattttctaccagcgcgggctcaaaagttgcaaatggctcatcaactactgcgagctcgaacacgaggagatagaagtcaaaacaccagaaggaaaactccgaaagataaccatcggatcaaaaacctgccccaaatcctcacccctattccaagagttcaaaatctggcaggtccttaacaacctacaagtatcgccactcaactccagacgaaaggcaaagaggaagaaagacgaggaaccgtccctcttcagcgacgaggacatgaacacagcttgtagatacctaaacgaagaggaaaaactgaccctcttcaaagaactatcgataaagaaagaactaaagaagaaagacgccctgaaactactattcgaaaattacaaagagctggaccttaactacaaagttatatcgggcaacgttaccatggcaaatctgtaccgcgcgttccaggacatcatctcgctaacgggcaacggtgagttcgatttccaggccatgccggccgaagaagcggagaaaactgtagaagaaatattcggaggcctgggctacaaaaccgccttcttacacttcgacgcaagtctacacgacaaagagttcgaacgccaaccggcataccgcctatggcatttgctctactcgtacgccggcgaccaaagcaaaaccggcatcgaagccctcgtaaaacgaatacaggaactatgcggattcgaaccagagtacgcaaggatactcgctaacatctcctttatccccgattacggcaacctctcctccaaagccatgcgaaaaatcctgccgtacatgcaggatggctacgaatactccgaggcgtgcagcaaggcaggctatcgtcactctgcaagcagcctcaccaaggaagaaataaacaagaaaaactacaaaacacacctcgacgaaattaaaagaaactccctacgcaacccgatcgtggagaaaatcctaaaccaaatggtgaacgtagtcaactcagtcatagacacctacagcaatatagacgaaatccgcatcgaaatggcccgcgaactaaagaaaagcaaacccgaaagagaagatatgagtttcgcgatatctaaagcaacaaaagagaccgagagaatcaaaggcatccttgaacaggagttcaaaatccaacacgtcacgcgaaacgatatcataagatacaggctatatgaagaactcaaaccgaacggatacaaaacgttgtacagcaatacctacatcccacgagaagacctcttctcgaaaaagttcgacatcgagcacataataccaaaagccagactattcgacgatagctactccaacaaaaccctcgaactccgcgacattaacatcgagaagggaaaccaaaccgcctacgactttgtcctgtcaaaatatggcgaagaaggcctgtacaaatatgaacagagagtcgaagagttcaagaagaacaatgagcaggcgggcacgaaatgccggaaactcttgatgagagaagcagacataccaagcgacttccttaacagggacctaaatgattcccaatacatagccaaaaaggcacacgaactcctccgggagatagtccccacagtcacggccacaactggcagcatcacaaatcgcttacgggaagactggaaacttgtgaatgtcatgaaagaactcaactgggaaaagtacgataaactaggcttaaccgaagagtacaaagacaaggacggaaacaccgtccgccacatcaaggactggaccaagcgtaacgatcaccgacaccacgcgatggacgccctaaccatcgcattcacgaagccctccttcatccaatacctcaacaacttaaacgccagatccaaccggggcggaagcatttacgggatcgagcagaaagagttggagagagaaaacaacaagttagtcttcatcccgccgatagacccgaagatcttcagaaaacaagcgaaggaacacctatccaacatcctcatcagcataaaggccaaaaataaagttgtgaccaaaaacgtgaataaaaccaaatcaaaatcaggcaccaaccgcaaagtacagctcacacccagaggccaactgcacctggaaaccgtctacggcaaaatcagaacctacaaaacggaggaaataaaagtggggacaaaactcaccgaggaattaatcgccaaagtggcagacaagaaaatccgcgaagcactcatgcagcgcttatccgagtacggcggaaacataaagaaagcgttccaaaacatatctaaacatcccatctggctcaatggaagccacactaaacacgtccccgagaaagtaaaaatcgtattctttgaagacgtcttcaccataagaaaggcgataacgccagacatcaaaatagacaaggtgatagactccaaaatccgacgaatactacaagaacgcctaaacgagttcggcggcgaagcatcgaaagcgttctccaacctcgacgaaaaccccatctggttcaaccgtgacaaaggcatcgcaataaagtccgtcaaaatccgcggcatcgccaaaggaacggccataagggttaagaaggatatccacggaaaaactataataggcaacaatggctaccccgtcgcgaacgattacgttaacaccggcaacaaccatcacgtagcaatcttccgtgacaaagacgggaacctacaggaacacatcgtttcattttacgaggcaaccgcacgagcaatccaaaacctgcctatcgtcgacaggaactataactccgaaaaggactggaaattcctattcagcatgaaacaaaacgaatattttgtctttccgaacccaaacacgggattcaacccctccgagatatcactaaaagatgagaaaaactacgccctcatctcaccgaatctcttccgcgtccagaagctaagccactactactatgtcttccgccaccacctcgaaaccaatgtcgacaccaacttacaactaaaagacataacatggaagcggatcacagctgtcaataacctgacaggagctgtcaaggtccgaatcgatcacctagggcgaatcgtcgacgtcggagaatacaagtga

SEQ ID NO: 6724 - RNA, 4176 nt, synthetic construct
  misc_feature 1..4176: note = Cas9 variant
  source 1..4176: mol_type = other RNA
atgaagaactaccacataggactagacataggcacatcaagtgtaggattcgccgcccgcgacgacgacaataacctcatacgagtgaaggggaaaaacgtgataggcgcgcgtctcttctccgagggccaaactgcacaagaaaggcggatggcgcgcacgtcccgtcgacggtacaaccgcaggaaatggcgcctcagactactcgacgaaatcttccatgatgaaattatacacaaagacgccgagttcttcaatcggctaaaacaatccttcctcagccccaaggacgaacggaagcaatacttcgggtccctcctgtttccggaaacaggcgacagcgaatactaccacaacggcaaccaaacaatataccacctccgccaccgcctcattacacaagacgagaaagccgacatcagagagatttatctagcactgcgacacattatcaaataccgcggaaacttcctcgacgatacccccgtatcgtccttcgaagccagcgacctcaagctcgcgagcttcgtcccgacgattaacgacctattcgagactattgacgtgaactacgaattttccatggacaacatcaacgaaatcgaggacatcctgctcaacaataagctgcgaaactccgacaaaagcaagcagctcaccgacttacttacagaacccatcgtaaatatagacgacaaatcactagaaaagcagttcaataaggaaaggaccgatatatccaaggaaatcgcaaagagcgtcgttggctccaaaatgaacgtcaacaaactcttatcgttcgagagcagcgaaggatccaaaatcgcgttctccttttctgacgcctccagcgaggacaaaatgatggaactaagcgatatcctagacgacagccgtatgaacatcctcaacatcctgaaagtaatctacagccgcgtccgtctaaaccaaatcatacccagcggaatgggcttgtcggaatcgatggtagccgcctacgactctcataagcaacaactcaaagacctgaagaccctgctaaacgtcttacccttcaacgaacgctacgccgtaaaaatcgcatacgcagcgtacatcggaaatatagacaaacaaaaattcaccaaaagcgaaatcaaagcgatcgacaaactcaaagagaaatccgccataatgaatgtactcgatttcaaatctggccacatcacaaacgaggaactaagcaacgtaatcaaagccgtaatcgtagacaaataccttaacgacgaggacttcgagtaccacggcatagtcgagaaaataaaccaagacatctccaacggctcgtacctgctaaaacagagaaataatcaaaacggcaacatcccacaccagctacatcaaatggaactcgaccagatcatagaaaaccaatcaaagtactatcacttcttgggcgagcttaaccccaacagcaatcgcaaccatatcgcaaaatacaagatctcggagctagtagctttccgggtcccatactatgtgggccccctaattacacctgaagaacaggagaaaacgtccggcgcgtctttcgcttggatgaaaagaaagaaagatggcgcgatcacgccctggaacttcgaagaaaaagtcgacaaagaagaaacagcgagccgtttcataaagcgcctcacagtcaaagatacatacctccttaacgaagacgtccttcctgacaactcgcttctctacgaaaaatttaaggtcctcaatgaactcaacgtggtcaaagccaataacaaacgactgacggtagaagaaaagcaaggcgcattcgacaatcttttcaaaaagatgaaaacagtcacagcgaagcgcctcaagaactatctcgtctcaaatcacaaccacatcaacagcgtagagataaccggcctttccgacggtgataaattcaacaattctctctcaacgtacatagattttaagaaaatattcggcgacaaaattgacaaccctggattactggacgactttgaggacatcatagagtggtccaccgtattcgaagaccggaaaatattcgaggaaaaagtcagaaaggacatctcctggatctccgaaagcgagataaaatcggtcgtatcgaagcgatacagcggctggggacgcctcagcaagaaactcctcaactgcatcacaaacaacgagggccgaaacataatcgacgaactgtgggaggaatcagaaacttttatggaagccgtctctaagcccgaagtaaaagaacagatcgacggcataaactcagacttcataaagaacacagacatcgaaagcgtcctggccgacgcttacacctccccacaaaacaagaaagccatccgggaaacgcacaaactcgtgaaagacatccaaaaagcaatgggcggccaagcccccgcatccatttcaatcgagttcactcggaacccccaggacaaaggacaactcacacgctcgcgccattccgaagtctctagaaaatacaaagaaatatccaaagaaatctccaaaaccctaaacgatgaactcaaatctaagaaaaactcaatggacgtagacaaatactacctctactttatgcaaatgggcatagacctctacgatggaagctccatcgacatagacgacctcaacaactaccaaattgaccacattatcccacagagcttttacaaagacgactcatttgacaaccgggtcctgacgcactactccaataaccaaaagaaaggcaataacacgcccctcaacggccttaacatcaacgacaaaacccgtgctatatggaaccaccttcgagatcttggcctcatcactaagaagaagtacaatggacttacactaaaaggcatggaccaactctccaaatacactaaacacggcttcataagacgacaactggtagaaacctcccaggttatcaaactcgtcgcaaacatcctatccgacgagttcagcactgacgacacgaaaataatagaagttaaagcgaagatgaatagccaaatccggcaggtattcaacctctacaaagtacgagaacttaacgactaccaccacgcagtcgacgcctacctaaccacattcattggcgggtacctatataaccgctacccgaacttacgcaacatgttcgtctacggcgacttcaagaaattctcagctgacgtagacaacctcaaaacctttaacttcctccatgaaattacgaacccgtccgacaaatttgaggacaggatcttcgatgaaaagagcggcgagttgattctagaccgcaaacacgctatcgaaacaatcaagaaaatttaccaatataaatacatgctaatcacgcgagaggtgtcaactaaaaacggacaactcagcgaccaaaccgtatacagcgctaagcgcataaacaacgtcaaagcgccgatacctgtcaaaaaggacttcaacccagaactatacggcttccggacaggcaacgtggatcaccacatggtaatcgtgaaataccccaagaaggacagctacgactacaaagtagttgggatcccactccgattcgtccagaaactcaaagaaactaaagacaacaaggactacgagaacctgctcaaccagatcgtccaaatgaaactcaaccgaaagaagcaagacttcatcgttgtagtagacaacgtaatgtacggacagctcatccaagacggcggtcaaaagttcacactcggatcaagcacataccgttacaacgccaagcagctagtcatagacaacggctacctcaaattaatcgcagatgagagatataagaactccctcacagacgaagagaaatccaaccaatatatcaccctttataatgaaatcctaaaagtcgtcaacggacgattcgacgtattcgacgttaacagcttccgcaaaaagctcaacaacggggtcgacaaattcatcaagctcaacacagtcgataaacgcataatcatcatgaagatcctcagcgggctccactgtggccctagcatcgtgcctctgaaagagctcggactaactacacccctagggcaattgcagagcaccagcggcatctccctctcagaaaacactatcatcatataccagtcgccatcaggcctcttcgaacgaaaggtccggctcggcgacctatga

SEQ ID NO: 6725 - RNA, 4176 nt, synthetic construct
  misc_feature 1..4176: note = Cas9 variant
  source 1..4176: mol_type = other RNA
atgaagaattaccacattggcctcgacatcggcacctcgtccgtcggattcgcagcccgcgacgacgataataacctaatacgtgtcaaaggcaaaaatgtgatcggagcacggctattctcagaaggcaaaacagcgcaggaacgacgcatctcacgcacctcccgacgacgttacaaccgccgaaagtggcggctccgtcttctagacgagatattccatgacgccatagttcacaaagacgccgagttctttaacagactcaaacagagctccctaagtccgaaggatgaacgcaaacaatatttcggttcccttctctttcccgaagtcggagacggtgactacttccgcgacgggaaccagacaatttaccatcttaggcacagactaatgacgcaggatgaaaaggcggacatcagggaagtctacctcgcactacgccacattatcaaatacagaggcaacttccttgacgacacgcctgtatcttcatttgaagcatcagacctcaaattagcctctttcgtccccacactcaacgacctattcgaaaccataaatgtcaactacgagctctcaatcgacaatgtcaaccagatagagaacatactactcaataacaaactccgaaacagcgacaagagtaaacaactcaccgacctaatagctgagcccgtcaccaacatcgatgacaaatccttgaagaaacaattcgacaaagagcgcaaagatatatcgaaggaaatcgccaaagcagtggtcggaagcaaaatgaacgtaaacaaactcctttcgttcgagagttccgacggatcgaagataagtttctcattcagcgacgcatcctccgaagacaaaatgttagagctctccgacatcctcgacgactcaagaatgaacatccttaatgtactaaaagtcatctactcccgcgttcgcctcaaccagataatcccctccggaatgggcctcagtgaatcgatgatcgcggcatatgacttacacaaacagcagctcaaagaccttaaaacgctattagacgtggtacccttcaacgaaaaatacgcagtgaaaatcgcatacgccgcctacataggcaacatcgacaagcagaggttcacaaaggctgaggtaaaaacaatagacaagctgcgcgacaagaagtccataacatccgtcctcgacttcaagtccggacacattacaaacgaagaactaaataacgtcatcaaagaggtcatagtagataaataccttaacgacgaaacattcgagtaccacgacatagtagagaaaatcaaccaggacataagcaacggcaactacctgctcaaacaaaggaacaatcaaaacggaaacataccccaccagctccaccaaatggagctcgaccaaataatagaaaagcaatccaagtactatccattcctcggcaaactgaacccaaacagcaaacgcagccacatcgccaagtacaaaatctcagagctagttgcgttccgcgtaccctactacgtggggccacttatcactccagaagaacaagagaaaacaagcggcgccagtttcgcctggatgaaacgcaaagaagacggcgccatcaccccatggaatttcgaaaagatggtagacaaagaaagcacggcctcacggttcataaaaagactcactgtcaaagatacctacctcctcaacgaagacgttctgcccgacaactctctcctctacgaaaagttcaaagtcctcaacgaactcaatgtcgtcaaagcgaacaacaagagactgactgtggaagagaagcaaggcgcgttcgacaacctcttcaagcagatgaaaacggtaacagccaagcgcctgaaaaactatctagtcagcaaccataaccacatcaactcagtcaagataaccggactatccgacggcgagaagttcaacaactcgctctcggtgtacatagacttcaagaaaatattcggcgacaaaatcgacgactccaaactattcgatgacttcgagaacatcatcgaatggtccacagtattcgaagatcgggatatcttcgaagaaaaggtccggaaagacatctcctggatctcagagagcgagataaacgccgtagtgtccaaacgctattccggatggggcagactcagcaagaaactcctaaacggcataactaacgacgagggacggaacatcatcgacgaactctgggaagaaagcgaaacattcatggaagccgttagcaaacccgaggtcaaagagaaaatcgatgaaattaatagcaacttcatcaaaaacacagacatcgagagcgtactagccgacgcttacacaagcccccaaaataagaaagccatacgggaaacatacaaactggtaaaagatatccagaaagcgatgggcggccaagccccctcctccatctccatagagtttactcgcaacccccaggataaaggagaactcaccaggagcagacactcagaaatcgccaagaaatacaaagaactctccaaagaagtatccaagaaactcaatgacgagctaaaaagcaagaaaaattcgatggacgtagataaatattacctgtacttcatgcaaatgggaattgacctctacgatggcacctccatcgacatcgatgacctcaacaactaccaaatagaccacatcgtcccacagagcttttacaaagacgattcgttcgacaaccgagtccttacacactatagcaacaaccaaaagaaaggcaacaacacgcccctaaacggcctaaacatagacagcaacacacgagaagtttggaaccacctcatcggacttggcctcattacgaaacgcaaatacaacaacctcaccctgaaaggcatggaccaattgtccaaatacaccaaacatggcttcatccgacgtcagctagtcgagacttctcaagtaattaagctcgtggccaatatcctcagcgacgaatactcgaaggacgacaccaaaataatagaagtgaaagccaaactaaactcgcaaattcgccaggtgttcaacctttataaaatcagggaactcaacgactaccaccacgccctggacgcataccttactacattcatagggggctacttgtacaacagatacccgaacctgcgcaacatgttcgtctacggggacttcaagaaattctccgcaaaaatagacaacctcgaaaccttcaattttctacacgacataacaaacccaagcgataaattcgaagacagaatcatagacgaaaaatccggagaagtaatcctggaccggcgccacgccatagagaccatcaaaaagatataccagtacaactacatgctgataacccgcgaagtcagcaccaaaaacggacagctctccgatcaaaccgtttactccgctcgacgcataaataaagtcaactcccccatccccgtaaagaaagactccaaccccgaactatacggtttccgcacgggcaacgtagaccaccacatggtaatcgtgaaatacctcaacaaagataaatacgattacaagataatcggaataccactcaggttcgtccaggtccttaagaactccaacgacaacaccgaatacaagaatatcctgaacaagatcgtccaatccaagctaaagggcaagtccaccgacttccgggtcatactcgacaacgtgatgtacggacaactcatacaggatggaggacagaaattcactctggggtcctcaacctacaagtacaacgctaaacagctagtcatcaacatggacgacatccgaatcctagtagataaccgatactttaactccctttccgacgacgacgcatccggagagttcatcaaaatctacaacgaaatcctaaaagtgatcaacgcacgattcgacttattcgacataaacaaattccgagaaaaactaaacaatggaaaagaatacttcgaaaacctaagcatcgacgagaaaaaccaggtactcttaaagatgctatcgggcctccactgcggatccgccaacgtacccataaaagaactcggattgacaacacccctgggcaaactgcagatcccaagcggaatcgtactaagcgaagacgctatcgtaatctatcaatccccatcaggccttttcgaaaggaaaataagacttaaggacatatga

SEQ ID NO: 6726 - RNA, 4176 nt, synthetic construct
  misc_feature 1..4176: note = Cas9 variant
  source 1..4176: mol_type = other RNA
atgaacctcagaaactatccgggagaatacagtatcggactagacatgggcacaggttcagtcggctggtccgtagtcgatgagaagggtaacctacttcatttcaaaaagaaaccaacatgggggagcagactcttcgactccgtcatgccagcctcggaagcccgagtacaccgaggacaacgacgacgctacgagagacgacgatggcgtctcgacttgctacaaggtctgttcaaaaacgagatgaacaaggtagaccccgagttctttatgagactcaaccagtcacgtaccatagaaggggacccgatcttcacaaagagtttcacgaaagccgactattacgacagattccccaccatataccacctgagagcttacctcatggaatcaaacgaacctgcagacctccgactgatatacctcgcaatgcacaacatcataaagcaccggggcaactttttacgggaagaagaaaagagcttgagtgcgaaacacgcggacagcaaaaaggcagtaacccaattcgtagacgcgctcaaagaatggtgtttttcacgagggtacgagttcggtaaggaccccgcaaagtcaatagaaaagtgtctgagcgattctaaatcatcccgaagccaactcgcctcggaaatcgcaaaggccctggccgttagcacggacgcagcagccgcggacaagaaactggcagataacttagccaaagcaatggtaggcctacaatgcgagttcaaatacgtattcggagaatttgactgtgaatccaccaaactcgcgctgtcagacgacgaaaaactagaattactaagggcagcgtgcccggacgattcagtagaactactcgacgcactctgcgccgtatactcagcctacgtgctgcaaggcctgctcagctatgccccaggacaaaccatctcacacaatatgatcgccaaatacgacctatacaaaaccgacctgaaaactctccgtgcattggtccgagaatacgccccgggagcctacgacgagttcttcagaggggctacgtaccacgacgcgaacccagacgactcctcgaaagactacagttacgccgacgcggaaggctacaccgcgtacaacctacacaaactatcctacgacgacttcgccaaagcagttaagaaactactaggtgggacggacgccgtcacagatgaaagataccttaacatgatggaacgcttcgaaaaacagcaattcctaagacgactgaaaacgagcgacaacggggcgatatactaccagctccacctagaggagttaaccgcgataattaaaaaccaaggcagattttacagctttctgaaagaatacgaaggaaaattcgaatccctcgtatcattccggataccgtactacgtcgggccattaacaagcgtcaacgccgcccaggactcacacaaccacaaccgatttcagtggagcgaacgtaagccgggcatggagcgagaagtcatcaccccatggaactgggacaccatcatagacaaaaacaagagcgccgaaaacttcatcatgcggatgaccggagactgcacctacctcgcaggagaaaaggttctaccaaaacaaagcctcctgtacgaagagttctgcgtactaaacgagctcaacggcgtccgatggagcgatgacggcgacgactggcagcgcttcgacgcagcacaacgagagggaatagttcgcgagctattccacaaataccgccgtgtcacgtacaagatgctagaagactggctcgttagagaaggagacgctaatcacccaatcgtaaagggaggacagggcgaaaccgggctggaaagcaaaatggggagctacctcttcttcgccaagggaatattcggactgggcgaactttccccggccgagtaccctgccattgagaaaatgattaaatggaacacactattcgaagatcgaagcatacttaaagaaaagctggaagatgagttcggcgaacgcgggaatggaatgttggacgccagccaaatcaaagcaatctgcaagaaaagattcacgggctggggccgactcagcgaacaatttctaacgggactcaaagtagaatctccggccggcagagcagtctcaatcatggacgtactccgagaaggaaacccgtgctcagagaggaggcaaggagaaacggtcgtcatgatggaggcgctgagagacgaaggactcgggttccagaaaaagatagacgaacacaaccgaaactactacgggcaacacggtaaggatctcggggtcaacgaactccccgggagcccagctatacgccgcagtctcaaccaggcaatcaggatagtagaggagatagcaagcatagccggccacgccccagctaacatcttcatcgaagtgacccgcggagaagacgcaggcaagaaaggcaaaagaacggtaaaacgctgggacaaaataggggaagcactgaaaaagctaaaagaagagggggtcgccgtagaggtcatggacgactttaaagaacagaaagcgataaacgccaacctagacgaacgattaagcctatatctaatgcagaacggcaaatgcctatactcaggcaaagccataaacctagaaaaactactagccggatctggcgaatacgaagtcgaccacataataccaagagcctacatcaaagacgactccatcgaaaataaggcgctagtactaagagaggagaaccagcacaagacagaccaactgctcatagacaagtcgatacgatggaaaatgagagaaacatggagccagttacacgacgcagggctcataggcgataagaagtaccacaacctccttcgatcaaacataaatgaaaaccagctgcgaggtttcatcgctaggcagctggtcgagacttcccagatggtcaaactagcgcaagcactgctagaagcacgcttcgcgaatgaagagacaagaattgtcccagtgaaagcgtcaatgagccacaacctacgggaagccgccgaccttgcaaaatgcagagaagccaatgactttcaccatgcgcacgacgccttccttgcctccaggataggactcttcgtccaaatgcgccacccgggaatatacgaaaaccccatcggctacagccacgtgatcaagaaatacgtccaagaacaatcggaggtgttcaaaaagacacacaggatgccgggaagcgcgggatttgtaatcaacagcttcatgagcagcggcttcgataaggacactggtgaagtgtttaaggacagctgggacgcagaggcagaggtagacgggatcaggaaagcacttaactacagacaatgctatatatcccgcatgccgcagcaagacacgggggccttctggaacgcgacagtctattcaccccgagaccctaaaatgggtcctaaactagccctgagtacaaaacaagggctcgaccctaaactgtatgggggattctcgtcccaacagttcgcgtacttcttcatatacgaagcgaaaaagaaaggcaaaccgacattcaggttctcgcaagttcccgtatggttggccgcgcgcatcgaggcgaacccactggccctagaggaatatgcccgagggctagccaaaggagagggactagagttcgtctcaatccaacgcccgaagatatacaaaaagcaactaatagaggtaaacggcgacaaactgataatcacgggcgcaaaggaagtgagaagcggagccgaactagcgttcaaccaagacgagatctcggccataagcatgtgtagcaaactaagggccgccgaagcaggcttggacggcgccttcagcgaagaagtgtccgccatctggaaccgcatctccaatgcacccgtgcagagctgtggacggctcctacgacaactaacgctaccaaaatatcaatcgaacttcgacagcagttccaacgaagaaaaagccgcagtagtactcggactcatcgcgctgctaaacggcaacaaccgaatagtcgacctctcaggcgtaggaggaagcagccacgccggagctatgatgatgtcatacccgaaactgctagacgacccgaaagtcccattcttcatcattgaccaaagcgtcaccggaatgtttgagcgaaagacccgcgtcggcttatga

SEQ ID NO: 6727 - RNA, 4176 nt, synthetic construct
  misc_feature 1..4176: note = Cas9 variant
  source 1..4176: mol_type = other RNA
atgaagaaaatcctcggcttagacctagggacaacgtcaatcggatgggcgctcgtaaatgaaaaagaaaacaatgaggagcagtcttccatcataagactaggagtccgtgtaaaccctctgacagtagacgaaaaatcaaacttcgaaaagggcaaggacatcaccactaacgcggacagaaccaagtgtcgctccgctcgtcgaaaccttcaaagattcaaactccgccgcgaagccttggcggactgcctaaagcgacacggactgatgaccgacgaaacacccctgtgcgaaaccaataacagcataatattcaaaacttactcaaacagggctaaggccgtctgcgagaagatcgccctcgatgacttcgtcagggtattattcatgataaataagaaacgcggctacaaaagctcccgcaaattgaacaccgacgacgaaggtactctcgtcgacggtatggacgtcgcgaaattactttacaacgagcaaatcacgccaggcgagtacctcttacgactcttcaaaaagggtaaaaagacgcgaccggatttctacttgagcgacctgaaagccgaactagaaagaatatgggacttccaaagaacattttacccggagatcctctgcgacgcgctgaaagaagatctcaagggaaaatccagaacacagtccagcgccattttctacgcaaagtacaaggttagcacagcaaaaatcgcgggaaaggacaaacgactacaggaactcacatggcgaaccgacgcactccggaagcaacttaccatagacgaagtagcctacgtaatatgctccatcaacggagaaataaacggctcctcacagcggcttagcatgatatccgaccgctcaaaactcctctatttcaaccaccaaaccatcggacagtacctaatgcaacgactggaagagaacccaaacgcaggcctgaagaacatcatcttctaccgtcaagactatgaagacgaatttaacgatatatggaactcccaagccacataccataaagaactaacacccgaactcaagaaggagctcaaagacatcatcttctaccaacgcggcctaaaaagctgcaagtggcttatcaactactgcgagctggagcacgaggaaatcgaagtcaaaacacccgaaggcaaattacgaaaaataaccatcggttcaaagacttgcccaaaatcatcacccctgttccaagaatttaagatatggcaagtcctcaacaacctgcaagttagccccctgaactcacgacgcaaagccaaacgtaagaaagacgaggaaccgagcctattctctgacgaggatatgaatacagcttgccgctacctgaacgaagaagaaaaactaacactcttcaaagaactctccataaagaaagaactaaagaagaaagacgcactcaaactcttgttcgaaaattacaaggagctggacctaaactacaaagtcatatcagggaacgtaaccatggcaagcctataccgggcgttccaagacatcatctcactcaccgggaacggagagttcgacttccaagcgatgccagccgaagaagccgagaaaaccgtagaagaaatattcggcggccttggatacaaaacagcattcctccacttcgacgcgtccctacacggcaaagagttcgaaagacaacccgcctatcgcctatggcacctcctctactcctacgccggcgaccaatccaaaaccggaatcgaagccctggtcaaacgaatacaggaactttgtggattcgaaccagagtacgctcgcatcctcgcaaacataagttttatccccgactacgggaacctaagcagcaaagccatgagaaagatcctaccgtacatgcaagacggttacgagtactccgaggcttgctcgaaagccggataccggcactcggcgtccagtctcacaaaagaagaaatcaacaagaaaacttacaaaacgcacctcgatgaaatcaagcgcaacagcctaagaaacccgatagtagaaaagatactgaatcaaatggtaaacgtagtcaactccgtgatcgacacttacggatccatagatgaaattcgcatcgagatggcccgggaactcaagaaatccaagcctgagcgtgaggatatgagcttcgcaatcaacaaggcgacaaaagaaacagaacgcatcaaaggcatcctcgagcaggagttcaaaatacaacatgtaacacggaacgacataataaggtatcgcctatacgaggaactcaaaccaaatggctacaaaacactctacagcaacacgtatattccacgagaagacctcttctccaagaaatttgacatcgaacacatcatccccaaagcccgccttttcgacgactcctattcaaacaagacgctggagctgcgggatatcaacatcgaaaagggcaaccaaaccgcctacgacttcgtcctcagcaaatacggagaagaaggcctatacaagtacgaacagcgtgtagaagagttcaagaagaacaacgaacaggcaggaagtaaatgccgcaagctcctcatgcgcgaagccgacataccaagcgatttcctcaatcgagacctaaacgactcccaatacatcgcaaagaaagcccacgagctcctgcgcgaaatcgtaccaaccgtgacagccaccacgggatctataaccaaccggttacgcgaagactggaaactggtgaacgtcatgaaagagctcaactgggaaaaatatgacaaactcggcctgaccgaagaatataaggacaaggatggcaacacagtcagacacataaaggactggacaaagcgcaatgaccaccggcaccacgccatggacgccctcacgatcgccttcactaagccgtcctttatccagtacctgaacaacctaaacgcccgctcgaacaaaggtggatcaatctacggaatcgaacaaaaagagctagagagagagaacaataagctagttttcatcccgcccatagaccccaaaatcttccggaaacaggcaaaagagcacttgtcgaacatcctcataagcatcaaagcgaaaaataaagttgtgaccaagaacgtcaacaaaaccaaaagcaaatccggaactaacagaaaagttcaactcacgccccgaggacaactacacctagagaccgtctacgggaaaatacgcacctacaaaaccgaggaaatcaaagtcggcaccaagttgactgaggaactcatagcaaaggtcgccgacaagaaaatacgtgaagccctaatgcaacgcttatcggagtatggaggcaacattaagaaagcattccaaaatatcagcaaacacccaatctggctaaattcgagccatacaaaacatgtccccgagaaagtaaaaattgtgttcttcgaggacgtatttaccatacgtaaagccataacaccagacataaaaatagacaaagtcatcaacagcaaaatccgcaacatcctccaggagcgactcaacgaatttggtggagaagctgccaaagcattctcaaacctcgatcagaacccaatctggttcaacaaagataaaggcatagcgatcaaatcagtcaaaattagaggcatagcgaatggaaccgcaatccgcgtgaagaaagacatccacggcaacaccatcattggcaacaacggatacccaatcccaaacgactacgtcaacaccggtaacaaccaccacgtagcaatcttccgagacagagacgggaacttacaagaacacatagtgtcgttctatgaagcaaccgcacgtgccatccaaaacctcccaattgtagaccgaaactacaacagtgagaaagactgggagttcctcttctcaatgaaacaaaacgaatacttcgtattcccaaaccccaacacggggttcaacccgctcgaaatagacctgcgaaacgaagaaaactacgccctcatctccccaaacttattccgcgtgcaaaaattatcacattactactatgtatttcgacatcacctcgaaacaaacgtcgacaccaacctgcagctcaaagacataacatggaaacgtatcaaagcaattaacaacctgaccggagtagtaaaagtccgcattgaccatctaggtcgcatcgtagacgtcggagaatacaaatga

SEQ ID NO: 6728 - RNA, 4176 nt, synthetic construct
  misc_feature 1..4176: note = Cas9 variant
  source 1..4176: mol_type = other RNA
atgaagaagaggatcgacgactacatcctgggtctcgacatcggcaccaactcatgcggctgggcagtcaccgacaagaaaaataacctcttaaaactgcgcggcaaaacagcaattggctcacacctattcgaagaaggccacaccgcagcggacaggcgaggctttcgtacaaccagacgccgcctcaaacgacggaaatggcgcctgcgactgctcgaagagatattcgcagagcccatggccgaggttgacccaggcttcttcgtacgattgcaccagtcctgggtatcccctctcgacaaaagccgaaagaaataccaggcaattgtcttcccaaccgccaaagaagaccaagaatactaccagaagtaccccaccatctaccacctcagagacgcactcatgacccaagaccgccaattcgacttacgcgagatctttttagccatccaccacattgtaaaataccgaggtaacttcttgcaagacacagcggtcaaggacttcgaagcgtcaaagatcgaagtgggccccatcttaaccaacatcaacaacgccttcgccgacaaaatagtagaaggtcaggaccttattgaactcaacgtcgccaacgcagctgaaatcgaggctgtaatcagaggaaaggacgctgacaaaaccctatacaaaatggacaaggtgaagaaaatagcaaaactattgaccgacagcaccgctaaagagcagaaaaacgtcgccaagcaaatagcaaacgccatcatgggctacaagacccaactcgagaccatcctcggaaaagaaatcgacaaaaacgacaaagcacaatgggagttcaaactttcagacgccgacgacaagctagatgcgcttctacccgatctagacgaatccgaccaaaccgttgtcgcagaaatagagaagctgttctccgcgatcacgttgtcgaccatcgtagacgaaaacaagtcactcagccaatcaatggttgagaaatacaacaaacaccaccaagactacaaactactgaaagcatacatcgaaagcctgcctgacagagcacaagcgaaaaagctactactcgcctacgacctatacgtcaacaatcgccacggtcacctactagaagccaaaacggagttcaaacaggactccaccctcacaaaagaagacttctataagaccgtgaaagacaacctagacgactccgaactagcacacaaaatagcgcaagaaattgccgccgacaatttcatgcccaagcaacgcacgaacagcaacggcgtaatacccttccaactccaccaaatcgagctcgacaaaatcatcgccaatcagtcgaaatactaccccttcctagccgcggaaaatcctgtcgaggaccaccgcaaacaagccccctacaaactagacgaactggttaggttcagagtgccctactacgtcgggccaatgataaccgccgacgagcaagagaaaaccagcggaaaatcctttgcgtggatggttagaaaagaacagggacaaattaccccatggaactttgaacagaaggtcgaccgccaggaatcagccaacaagttcatcaagcgcatgaccatcaaagacacatacctactaggagaagacgtactcccagcaaactccctgctataccaacgcttcgaagttctcaacgaactcaacaacatccgtgtcaacggctcacggatctcagtcgacctcaaacaacaaatctttaatgacttgttcgaagaaaagaaaaccgtcaccgaaaaagcattaatatcctacttgaaacagaaccttcacctccccactgtcgaaatcaagggcctggccgaccccaccaagttcaattcgagcctggcatcatactatcacctcaaaaacctacacgtattcgacaaagaactagcggacccgcagtaccagaaagagtttgagaaaatcatcgaatactcgagtattttcgaagacaagaagatcttccaagacaagctccacgcggagttcaaatggctcacccccgcccaattcaaggcaatatctacctggcgattacaaggatggggccgactatcccgcaaattactggtcgagctacacgacactaacggccaaaacatcatcgaacaactctgggacagccagaaaaacttcatgcaaatagtgacggaacccgacttcaaagaagccatcgccaaagaaaaccaaaatatcacacaagaaaacggcgttgaagagatcctcgccgacgcatacacctctcctgcaaataagaaagccatacgccaggtcgttaaagtcgtcgccgacgttgtcaaagcagcctccgggaaagccccagcacaattcgcgatcgagtttaccagagacccggacaagaaccctcaactatcacatatacgaggcaccaaacttctgaaggcttaccaagaaaccgccggagaacttgtcgaccagaacctcaccaatagcctaaaagaggcaatgacgtcacgcaaattgctgaaagacaagtacttcctatacttcatgcaaacaggacgagacgcttatacagggaagaaaatcaacattgatgaggtatccacaaactaccaaatagaccacatacttcctcagagcttcatcaaagacgactccttcgacaaccgagttctcacagcaacgccactgaacgctgagaaaagcgatgatgtgccttacaaaagattcgcgaacaactacgtttcggaccttaaaatgacagtaggagaaatgtggaagcactggcagaaagccggaatcataaacaagcacaaactcggcaacttactgcttgaccccgaccggctctctaaattccaaaaatctggcttcataaaccgacagctcgtggaaacatcgcaaatcgtcaagctagtctccgtaatcttacaaaacaagtaccccgacgccgaaatcatcaccgtaaaagccggagacaactcagcactccgccagcgcctcgacctgtacaaatcccgcgacgtgaacgactaccatcacgctatcgacgcctacctatccatagtctgcggcaacttcctgtaccaggtctatcctaagtaccgcccctacttcgtctacggccagtttaagaaattctcacaggacccagacctccagaaggacctaatcaagcactttaaaggcttcaccttcatgtggcccctactccaaaaggataactccgaacgcaaggccctagaagaaatcaaagaaaataactccgatagaatcgtcttctacaaacacccagacatcttcgacaaactgagaaaagcctataattacaagtacatgctcgtatcgcgtgaaaccagcactgaatcttcttccatgttcaatatgactatatacccccgaggtgaacgagaccgcaagaaaactcgcaaactcataccgaaaggcaacggactagacccaaaaatttacggcgggtacagcgggaacaccgacgcctacatggttatcgttaaaatagaaaaagccaaggaatcaatctacaaggtcatcggcatacccatgcgcgccctagcaggactcaaacaagccaaaaaccaaggcaactacaaggaagaactgcacaaggtcgttgagccccaaatcatgctggataaaaacgggaagccgaaacggggtgtggaaggatttcgagttgtcaaagaccacgtacccttcaaacaagtagtcctagacggagacaagaaattcatgctctacagcgccaaatacgaaaccaacgcgaagcaactcacactcagccaagagactatgcggatcgtaacagacaacctgaagaaatccgaggaccaggacaaactcctagtaaaagcctatgatgagatcctccaaaaagtcgaccaataccttccacttttcgacgtcaacaaattccgaaactctctgcacctaggccgcgcgaaattcctcgacctcgcagtcaacgataagaaaattacccttagcaacatattaaacggactgcacgacaacctcgtcgtccccaaccttaaaaacataggtataaagacgccgttcggtctaatgcagagtccctctgggatcacactatcaagcaacgccatactcatctttcagagtccaacggggctattcgagaaacgcgtacgcatagcggacctatga

SEQ ID NO: 6729 - RNA, 4176 nt, synthetic construct
  misc_feature 1..4176: note = Cas9 variant
  source 1..4176: mol_type = other RNA
atggaaaacaagcaatactacatagggctggatgtgggaacgaacagcgtgggctgggccgtcaccgacacatcctataatctcctacgcgccaagggaaaggacatgtggggagcacgcctcttcgacgaagcaaagaccgctgtcgagcggagaaccaaacgtacctcacgaagaaggtccgagcgagaaaaagcccgcaaagcgatgctcaaagaactttttgcggacgaaataaacaaggtggaccccaacttcttcatccgactggaggagagtaagttcttcctcgacgacaggtcagaaaataaccggcaacgatacacactcttcaacgacgcaaaattcaccgacaaagactactacgagaagtacaaaacgatcttccacctccgttcggcgctgataaactcggacgaaaagttcgacgtaagactcgtattcctagcgatactaaatctgttcagccatcgaggccacttcctaaacgcatcactgaagggcgacggagaaattcagggcgtggacatattctacaacgacctatacgaagtgtgcgaggagttcgagatcgatctcccacagatcagtaacattgacaactttgaaaagatactaagccaaaaaggaaagagccgcactaagatcctagaggaactatcggaggagctgagcatctccaagaaagagaaaataaaatacagtctactgaaactcatatgcggcatgaaaatcaaagtcgtcgatatctacgcggacgaagacatacaggaagacgataagaagaaagacctgggctttagagagagtgattacgagaaaagcagtctagaggtaaaagagatcatcggagacgaccactttgagctaatcgaacgtgcgaaagcggtccacgacatcggcctgctggccaacatcatcggtaactcaaagtacctctgcgaagctcgggtcgaagcctatgacaaccaccacaaagacctacagaaaatcaaagagctcctcaagaagtacgacatcaaagcctatacggacatgttcagaaaaatgacggacaaaaattactccgcttacgtaggatccgtgaacagcaacatagcaaaagaaaggcgtagcgtggataatcggaaaatcgaagatttgtacgagtacataaagaagatcgccctgaaaaacataagcgacgacaacgaagacaaaatcgaaatcctgaagaaaatagaaaccggagagttcctgaaaaagcaactaacagcctcgaacggcgtgatcccaaaccaactccaaagcagggaactacgggcaatcctcaaaaaggcagaaaattacctccccttcctgaaggagaagggggaaaagaacctcaccgtcagcgaaatgataatacagctatttgaatttcaaataccctattacgtgggccccctagataaaaaccccaagaaggacaagaatgccaacagctgggccgtaataccgagcggtgggcggatcctaccctggaacttcgaagataaggtcgatgtgaaaggctcccgcaaagagttcatcgagaagatggtaaggaaatgcacatacctaagcgaggaacacacgcttcccaagcagtctctactatacgaaaagttcatggtactaaacgaaatcaataacatcaaaatcgacggcgagaagataagcgtcgaggcaaaacaaaagatatacaacgacttattcatgaaggggaaaaaggtaagtcaaaaggccatcaagcaggaactaatctcactgaacatcatgagcaaagacagcgtactatcaggaatagacacggtgtgcaacgcctaccttagtagcatcgccaagttcagaggtgtattcgatgaaaacgtaaacaaccaatcaacaatcgacatgatcgaagacataatcttcctgaaaacagtgtacagcgacgagaagcgattcgtgaaagaagagatcgttgaaaagtacggcgacgagatcgacaaagacaaaataaaacgcatcctggggttcaaattcagcaattggggaaacatatcaaagagcttcctcgagctagaaggagcggacgtcggcacaggcgaaatccgaagcataatccaaagcctatgggagacaaactttaatctaatggaacttctgtcctccagattcacctacatggatgaactggaaaaacgcgtgaagaaactcgagaaacccctatccgagtggacgatcgaagacctcgacgacatgtatttaagtagccccgtcaagaggatgatatggcagtcgatgaaaatcgttgacgagatccagacagtaataggatacgcaccgaaaaggatcttcgtcgaaatgacccgctcggagggagaaaaagtacgcacaaaatcacgcaaagaccgactgaaagaactgtacagtgccataaaagaagacagtaaacaatgggtaaaagagctggacgcgaaggacgagtcatactttcgcagcaaaaagatgtacctctactacctgcagaaagggcgctgcatgtattcaggtgaggttatagaactcgacaagctaatggacgacaacctgtacgacatagaccacatctacccgcgcagcttcgtcaaggacgacagcctcgataacctcgtacttgtcaagaaagagatcaacaaccggaaacaaaatgaccccatcacaccccagatccaggcatcctgccaaggattctggaaagtcctacacgaacaaggatttataagcaacgaaaaatatagcaggctgacccgcaaaacccaggagtttagcgacgaggaaaaattgagctttataaaccgccagatcgtcgagacgggacaggccaccaagtgcatggcgcaaatactccaaaaatcgatgggggaagacgttgacgtagtcttctccaaagcgcgtctagtctcagagttccgacacaaattcgaactatttaaatcccgcctcataaacgatttccaccacgccaacgacgcgtaccttaacatagtcgtcggcaacagctacttcgtaaagtttacccgcaaccccgcaaacttcataaaagacgcacgcaaaaatcccgacaacccggcatacaagtaccacatggaccgattcttcgaacgagacgtaaagagcaaatcagaggtggcatggatcggtcagtcggagggcaacgccggaacgatcgcaatcgtaaagaaaaccatgagcaaaaatagcccgctgataaccaaaaaggtagaggaagggcacgggtcaatcaccaaagaaaccatcgtcggcgtaaaggagataaaatttggccgcaacaaagtcgaaaaggccgacaaaacccccaagaaagcgaacctacaagcctaccgcccgataaaaacgtccgacgagcggctatgcaacattttgagatacggcggccgcacctccatcagcataagcggatactgcctagtcgaatacgttaagaaaagaaaaacaatcagaagcctggaggcgatccccgtctacctggggcgcaaagacagcctaagcgaagaaaaactcctaaactacttccgctacaacctaaacgacggaggaaaagactcagtcagcgacatacggttgtgcctgccattcatcagcaccaactcgcttgtcaaaatcgacggatacctctactacctcggcgggaagaacgacgaccgaatccaactatacaacgcataccaactgaagatgaaaaaggaagaggtcgagtacatcagaaagatagagaaagccgtctccatgtcgaaattcgacgagatcgaccgggagaaaaacccagttctaacggaagaaaagaacatagaactatacaacaaaatacaagacaagttcgaaaacacagtgttctcaaaacgaatgagcctagtaaaatacaacaaaaaggacctctcattcggggacttcctcaaaaacaagaaatcgaaattcgaagaaatcgacctagaaaaacaatgcaaagtactatacaatataattttcaacctaagtaatctaaaagaggtagacctaagcgatatcggagggagcaagagtacgggaaaatgccgatgcaagaaaaacatcacaaactacaaagagttcaagctgatacagcagtcaatcacagggctttactcatgcgaaaaggacctaatgacgatctga

SEQ ID NO: 6730 - RNA, 4176 nt, synthetic construct
  misc_feature 1..4176: note = Cas9 variant
  source 1..4176: mol_type = other RNA
atgaaacgcaacaacgactactacataggattagacatgggtactaacagcgtaggatgggccaccaccaacccacagggcaggctactccgtttcaacaagaaagatatgtgggggtcacgcctatttgaggaagcgaaaacagcggcgaagacacgcaccttccggacctctagaagaaggtacgaccgagtccggcaacgcatagagttcctccaagacatcttcgcgccaatcatcgctaagaaggacttcgagttctttatgagactcaaagaaagtaaatttcacctcgaagataagaaaaccgacgggaaattcgccctcttcaacgacgccgacttcacagacgtagaatacttcgaccggtaccccaccatctaccacctccgggcagccctcatcaaaccaaaccacatcacggacccccgactgctctatttagcgatccaccacatcatcaagaaccgaggccactttttattcgcaggaaccgacatggaatccatccgctccttccagatagtctacacgcaactatccgaacatctgaagtccattaacctagacttcgagctcccagtcgacgcccaagacaaattcgccgccatactcctaaacgagaaactcaacaagcgcgacaaaaagaagcaactgaaagagctctgtccgcacaaagacaaaagacttgaatacgcatttaacgccataataggtggaaagacaaagctaaaagacatctttggggtcgaggaatatgacgaaggcaccaagaaagcggttgacttcgagaaagcggactacgacgaggacaaagacgaaatcgagagcgtaatcaaagagaacatccacgtgcttaacgccctcaaggccgtttacgactggaccatactaaccaacatactcggcgactacgcatacataagcgaatcacaggtagcattatacgaagcgcacaagaaagacctccgaatcctcaaatcactcatcaagaaatatgccaaatcgcaatacgcagacgcctttcgccacgaaaacgtcaaaggaaactacgccaactacgtaggaagtaccaactacgacaacaagcaacccgtcatcgacaacccctcagtgacacaagaagacataaataaatactttgctgatatactgctctcaatcaccccggacgaatcggaccgggagtcgtaccagtacataacggaacgcctccacaagggggaggctctcccaaagttacgaacaaaagccaacagcgtattgccccaccagatacacaaaatcgagctagagaaaatcctggccaacgcagcgaagaacttcccgttcctacaggaaaaagactcctcaggctacacagccgcccagaaaatcgtgaaaataatgatgtttcgtattgaatattacgtcgggcccctgaacacataccaccacgtagaccaaggcggccacgcctggatggtgagaaaggcggaaggcaaaataacaccatggaacttcgacgaaaaagtagacaaagaggcgagcgccgaaaagttcatacgcaacatgacgaacaaatgtacctaccttatagggaaggatgtcatcccaaagcaaagcctcctgtactcccgctacaaagtcctcaacgaactgaacaacctaaaagtaaatggcgccccaatatccgtcgcactgaaacagaaaatctatgaagaacttttcaagaaacaagtaaacgtcacattcaatcaactgaagacattcctaaaaacacaaggcgaggacgcggacgaaattattctatccggagtcgacgaggcggcacataaattcaccaacaacctccaaacctatcacaagttccgcgcgatactacgcgacaaaatcgagttcgaaccccaacgatcgatggtcgaggacatcatccgctggaagtgcctcatgggcgacgacatcactatgtggaagcacaagatcgaaaaggagtacggcgaccaactatcagaggaacagctcaaaaagatcacccgcttaaacttcaacggctggagccgactatcccaagagttcctcacagacgtacccggtgtagatatcgagtcaggagaggtctactcaggaattatggacgccctatggcggaccaatgagaacatcatgcaactgctcagctcccgcttcacgttcgcagccgaagtcaaaaagcaaaatcaaggcaccggccgaatcgagaaaatcacatacgacgaagtcatgaaggacacttacctatccccggccgtaaaaagatccgtctggcaggcaataaccctcgtggaagaaatccgcaaaatccgcaaagcggatcccaagaggatattcgtagaaatgacacgccagccagatgcaaagaaagaacgaaaactatcaagacgcactcaactcctaaacgcgtaccgcgcgataggcaacgacatcgccgaatacgaaaaagagcatgtgtcaactctaattacacaactcgaatccaagaaagacgaagacttacgtaggaagaaactctatctttacttcacacaaatgggccgctgcatgtacacaggagaacgtatagacctgagctccctactacgcgacaccaactcgaacatatacgatatcgaccacatatacccccggtccctaaccaaagatgactcgctagacaacaccgtcctatgcaagaaagaaataaatctcaagaaaggcaacaaatacatccaccgggtgttcaccgacaaagaacttaagaaacaatatggctactggaaagcactaaaagagaagaaacttataagcgagcggaaattctctcgactaatgcgcacaacagaccttaccgcagacgaacttgccggcttcataagccgccaactggtcgaaacctcgcaaatggtgaaagcgaccgccgacatccttgagaaaatatacccaaacgtgactatagtctacgttaaagctcggacagtctccgacttccgccacgactacgagctcccaaaagtccgcgccctcaacgattgccaccacgcacacgacgcctacctcaacatagtggtcggtaacgtatactacgaaaagttcacaaagtcacccttccgcttcatcgcgaatcaaaagggtaaaggcgatatcaagtacaacctctaccggctattcgacaaggacgtaaaggtaggcgacaggatcatctggaacgcaaaggaggacctcgcacgggtaaaggcaacactagagcgagacaccgttaacgtagtgcgcatgccggtcgagcagcggggccaatttttcgacgcaaccatacagaaaaagggaacgaccaaaaacatgctggttctacccctcaaaggctcagacgaacgtctccaagacacatccaaatacggttactatgtacgcccatcgggaatgagtttcatggtcgtccaacacgaagtcaagggcaaatcaagagtcacaatcgagccggcactcctagtatacaaaaacaaactcaaaagcgaagacgactacgccaaatactgcgaagatgtgctaaaactacagaaaccaaaggtcctattcaaaaacatcaaattcggctcaaagatacttttcgatgggtacccattcctgctcaaaggaagaacggagaacagaataatcatggcagatgcacagtctctcttccttggcaaccaagaactcaaaatcctaaaacgcgtaaccaaaatctccgacgacatagaccacaaagtagaaagccgtatcaaaatcaccgacgaagaatggaccacactctggaaatccgtagtagaacaaatagtcactggtaaattccgcaaccgactaggcacactgaacggcattctccagggacgcaaaatcaaactatccaaagacgaggaagcacgactaaacgaattagatagtaaagaccaagagacgttcctatctcaaattctcctggagagattcctacagttcagcaccgaagagaaaacccggctactcctacaagtcatatccttcagtggcaacacaaccggggtagatctccgactaatagggggatcttccggcacagggacaatcaaaacaaacaaaaacattaccgatcactctgtcatactcatcaacgaaagccccactgggctgttcaccaaccggacagtattgaaccaaccctga

SEQ ID NO: 6731 - RNA, 4176 nt, synthetic construct
  misc_feature 1..4176: note = Cas9 variant
  source 1..4176: mol_type = other RNA
atgaaacgtaacaatgattactacatcggcctcgacatgggcaccaacagcgtaggatgggccacaacaaacccccagggccgactcctccgatttaacaagaaagacatgtggggctcccgcttgtttgaagaagctaaaaccgccgctaaaacccgcacattccgcaccagccgacgtcgctacgaccgcgtacgacagcgaatcgagttcctgcaagacatattcgcaccaataatagcaaagaaagatttcgagttcttcatgcgcctcaaagaatcaaaattccacctcgaagacaagaaaaccgacggaaaattcgcactattcaacgacgcggacttcaccgacgttgaatacttcgacagatatcccaccatttaccacctccgagcggcactaatcaaaccaaaccacatcaccgatccccgattactatatttggcaatacaccacattatcaagaaccgcgggcacttcctattcgcagggacagacatggaatcgatccgatcattccaaatcgtctacacacaacttagcgaacacctaaaatcaatcaacctcgacttcgaactcccagtcgacgcccaggacaaattcgccgccatcctcctcaacgaaaaactaaacaagagagacaagaagaaacaattgaaagaattatgcccccacaaagacaaaagactagagtacgcgttcaatgccatcatcggtgggaaaaccaagctaaaggacatcttcggggtcgaagaatacgacgaaggcaccaagaaagcggtagactttgaaaaagcagactacgacgaagacaaagacgaaatagaatcagtaatcaaagagaacatccacgtactgaacgcacttaaggccgtttatgactggaccattctgacgaacatactaggcgattacgcctacatcagtgagagtcaagtggcgctctacgaagcccacaagaaagacctcaggattcttaaatcgctcattaaaaagtacgcgaaatcgcagtacgcagacgcatttcgccatgaaaatgtaaaaggaaattacgccaactacgtaggaagcactaactatgacaataaacaaccggttatcgacaacccaagcgtgactcaggaagatatcaacaaatacttcgcagacatactcctaagcatcacacccgatgaaagcgatcgcgaaagctatcaatacataacagagcgcctacacaagggagaagcactacccaaactaaggacgaaagccaattccgtcctaccccaccagatccacaagatcgagctcgaaaagatcctggccaacgccgcaaagaacttcccattcctacaagagaaagacagcagcggctacaccgcggcacagaaaattgtaaaaatcatgatgtttcgaatcgaatactatgtgggccctttaaacacataccaccacgtagaccaaggaggccatgcttggatggtcaggaaagcagaaggcaaaatcaccccttggaacttcgacgaaaaggtcgacaaagaagcgtcagccgagaaattcatccgcaatatgaccaacaagtgcacctacctcatcggcaaagacgtcatcccgaaacaatcgctcctatatagcagatacaaagtcctcaacgaactcaacaacctgaaagtgaacggggtcccaatcagcgtcgcactgaagcagaaaatctacgaggaactattcaagaaacaggttaacgtaacgttcaaccaacttaaaaccttcctaaaaacccaaggcgaggacgcggacgaaatcatcttatcgggcgtcgacgaggccgcccacaagttcaccaacaacctccagacctaccacaaatttcgagcgatactcagagacaagatcgagttcgaaccgcaacgatcgatggtcgaagacatcatccgctggaaatgcctcatgggagacgacataacaatgtggaaacacaaaatcgagaaagaatacggtgaccagctctccgaggaacaactaaagaaaatcacccggcttaacttcaacggctggtcccgacttagccaggagtttctgactgacgtccctggtgtcgatatagagtcaggcgaagtatactcgggaataatggacgcactatggcggaccaatgagaacatcatgcaactactcagctctcgattcacattcgcggcagaggtaaagaaacaaaaccaaggaaccggacggattgagaaaataacctacgatgaagtcatgaaagacacctacctaagcccagccgtaaagcggtcggtgtggcaagcaataaccctagtcgaagaaatccgaaaaatacgaaaagcagacccaaaacgcatcttcgtcgagatgacgcgacagcccgatgcgaagaaagaacgcaaactgtcacggagaacccagctactcaatgcgtatcgagccataggcaacgacatagccgaatatgaaaaagaacatgtatccacccttattactcaactggaaagcaagaaagacgaggacctcaggagaaagaaattgtacctctatttcacgcaaatggggaggtgcatgtacaccggagaaagaatagacttgtccagcctcttacgtgacacaaacagcaacatctacgacatcgaccacatctacccccggagtcttacaaaagacgactcgctggacaataccgtcctctgcaagaaagagatcaatctcaagaaaggcaacaaatacatccaccgcgtatttaccgacaaagaacttaagaaacaatatgggtactggaaagctctgaaagagaagaaactaatcagtgagagaaaattcagccgcctcatgcgcacaactgacttaaccgcggacgaactcgccgggttcatcagccgacagctagtagaaaccagccaaatggtgaaagccacagcagacatcctagagaaaatataccccaatgtcaccatcgtctacgtcaaagcccggaccgttagcgacttccgacacgactacgaactgccaaaagtccgggcactcaatgactgccaccacgcccacgacgcctacttaaacatagttgtggggaacgtctactacgaaaaattcacaaaaagccccttcagattcatagcaaaccagaagggaaagggcgacatcaaatacaacctataccgactgttcgacaaagacgtgaaagtgggcgaccgaatcatctggaacgcgaaggaagacctagcgagagtaaaagcgacattggaaagggatacggtcaacgtggtccgcatgcccgtcgaacaacgtgggcagttctttgacgccacgatccagaagaaagggaccaccaaaaacatgctagtgctgcccttgaaaggctcggacgagcgcctacaggacacctccaaatacggctactacgtccgcccctccggcatgagcttcatggtcgtccaacacgaagtgaaaggaaagagcagggtgactatagagcccgccctactcgtctacaaaaataaattaaaatcagaagacgactacgcgaaatactgcgaggacgtcctaaagctacaaaaaccaaaagtcctattcaagaacataaaattcgggtcgaaaatcctattcgacgggtaccccttcctactgaaagggcgcacggagaaccggatcattatggcagacgcacaaagcctgttcctcggcaaccaagaactcaaaatcctgaaacgggtcactaagatctcagacgatatagaccataaagtagaaagccgcataaaaatcaccgacgaggagtggacgacactgtggaaatccgtggtcgaacagatagtcacaggcaagttcagaaaccgcctaggaaccctcaacggcatcttacagggtagaaagatcaaactatccaaggacgaagaggccagactcaacgaactggacagcaaagaccaagaaacgttcctctcccaaatcctactagaacgattcctgcagttcagcacagaagaaaagacccgtctgctactccaagtaatatcattctcgggcaacaccaccggcgtcgacctccgattgatcggaggctcaagtggaaccggcaccatcaagaccaacaagaacatcacagaccactctgtaattctcattaacgagtctccgaccggcctcttcacgaatcgcaccgtcctaaaccagccatga

SEQ ID NO: 6732 - RNA, 4179 nt, synthetic construct
  misc_feature 1..4179: note = Cas9 variant
  source 1..4179: mol_type = other RNA
atgaaaagcatattagggttggatcttggaacaacctccatcggctgggcgctagtcaaagaatccgaaaacgacaacgagaaaagtgaaatcgtaaaactcggcgtaaggctagttcccctgacgacggacgaacgaactgacttcgaaaaaggaaaaagcataacgacgaacgcagaccgaacaagcaaacgctcaatgcgacgcaaccttcaaagatacaaactaagaagggaagcgctagtaagtgaactcaagaaagaacattggatagacgaaggctacaggttcagtgaagacggacctggaagcacattctccacgctccgactacgagcaaaagcagcagaagaagaaatcagcctccaggacctagcaaaagtgctcctccagataaacaaaaagcgaggctacaaatcctcacgcaaactaaacagcgcagaggacggacaagccatagacggcatgagcgtagccaaggtcctgtacgaccgcggcctaaccccaggcgagtatgtctaccaaaggatgttagacggccagtacgcgatccccgagttctacaaatctgacctccaggctgagttcgacaagatatggaacctacagaaaagttactaccccgaactcaccgcagaactatatgacaaactcacggacaagaacaaatcccaaacatgggccatctgccgcgacgaactaggcgtccaaggcttcaagagctccttcacgggaaaagaacggctcaaagaagcatacttcaaccgccagcaagcctcgaagcaaaaagtggacctagaggtactcacatgcgtgcttcaagacatcaatggacaaaaagcaagcctaagcgggctactaagcgcaataagcgaccggtccaaagaactttactttaaccgcatgaccgtcggacaaatgctagtaagacaaatccaggaagaccccaaccggtctctgcgcaacaccgtgttttaccgccaagattatatagacgaatttgaaaagatctggtccgtccaatcgaggttccatcctgagctaacccaagaacgaaagaagaaactgaaagacataataatattctaccaaaggccgctcaaaagtcaaaaaggactcataagcctttgcgagtttgaaagccgcgaagtggatatatcagtcgacggggtaataaagaaaaagaaaataggccctcgcgtatgcccccgatcatcacccctcttccaagagttcaaagtctaccaaacagttaacaacatcctggtcaacggagaaccgttagacgacaacgaccgggagaaactggtaggagaacttgcgttcagagagaaaatgaaaggacaagatgtactaaaactcctctacaagacaagcaagggaatgaggataaacttcgaagaagtggagggaaatcgaacaatggcaacgatactcaaagcatgcgagaaaatagtcgaaggactcggatacgacacccgcgatctctccaagatcacggcatcagaaaaggtgagccgtatagaagaaatattcgccaaggaaggtttcaaatcagacttcctacacttcgactcaagcctcccatcacccgagttcgaatcgcaggcaagctactccctatggcacctactatactcctacgaaaacgacaaaagcgtctcaggtaacgaaagcctcgtcgagaaaatcaagaagttatgctcaatggacgaggccagcgccaaaatacttagcggctgcacattcctcagtgattacggctccctgtcagcccgagcgatgcgcaaaatcctgccatacatgaaagacgggctggaatattcagcagcatgtgccatggcaggatacaggcacagcaagcgatcactcacaaaagaggaactcgacagccgagtttacgtagaccgccttgaattgctgcccaaaaactcgctacggaaccccgtagtagagaaaatcctcaaccaaatgatcaacgtcgtaaacagcgtagtggatacatacggaaagccagacgagatcaggatcgaaatggcgcgagagttaaagaaatcggccagcgagcgagaaaaagcacaaaaagacatagcagccgccagcaaggtcaatgaaagcatagtagccacactgaaggggagcccattcttcatagacagtcccagcagaaatgacataatcaggtaccggctatgggaggaactcaagccaaatggatacaaaacactgtacagcggcacgtacattccgaaagaaagactattctccaaagatttcgacattgaacatatcataccgcaagccctcctgttcgacgacagtttcgcgaacaagaccatcgaaagcaggcaatgcaacatagaaaaatccaaccggaccgccatggattacgtaaaaagcaagtacgacagcttcggcgtccaagcatacatagaccgagtaaaggggctaacgggcgtgagcaaaacaaaaatcaccaggctcctaatggagtcgaaagatatccctgaggatttcataaaccgggaactaagagacagccaatacatagctagaaaagcacgagaaatactagaaagcatggtaaaattcgtcgtacctacaacgggaagcgttaccgcgcgattgcgggaagactggcaactcgtgaatgtcatgcgagaactgaactgggacaaatacgagaaactcggactgacatcattccgcgaggatcgcgacggacgggaaatacctgttatcgaggactggacgaaacgtaacgaccaccgtcaccacgccatggacgcactcaccatagccttcacgaggaggcaattcatacagtacctaaaccatctaaatgcgaaaattgacaccgtcgataagaccgacatagacctccgggactacaacctggaggacatatccttcgacggcctcagagacggggacaagttcgggatagtaaaggcactgcagaaaaagtacctctacaaggacgacaaacaaaaataccggttcgtaccaccgatgccactcgacgagttccgcatagaagcaaaacgccagatcgaagacgtgctggtgagtttcaaagctaaaaacaaagtgtgtacgaaaaacgtcaacaccaccaaagtccgcggaggccaacagcgcaaaatacaattgacacccagaggccccctccatgaagacaccatatacggcaaacgactgcaatacgtaacaaaagaagaaaaagtagggggcagcttcgacgaagccaaaatagcctcagtctgcaaaaagagctatcgcgaagctctcatgagacgtctcatggaatgcgggggagaccccaagaaggcctttacaggcaaaaatagcctagagaaaaaccctgtctgggtagatgagttccactcaggagaagtccctctacgagtgaggaccgtctccatggcaagcgtgtatacagtacgtaaaagcgtaggccaatcactcaatatcgagaaagtacttgacaaacacatcaaggaaatcctgagagctcgcctcgaggagtatggcggaaatgcgtcgaaagcgttctctaacctagacgaaaacccgatctggctcaacaaggaaaaaggaatcgcggttaaaagagtcacaatcgactcaggcaaaaacccaatcccactccgctccaagttggacaaggacggacaaatcatctacggcgaaggccaaaatccccaggagagcgacttcgtggtgcccggcggaaaccaccatgcagccatctaccggacacctagcggcaagctacaagacgtggtcgtgagcttctatgaggcagtatcacgaaagaacctgggtctagaagtaatagacaggaattttaagaaagacgaaggctgggagttcttattcacactcaaacaaaacgaatacttcgtcttcccgaaccccgcaacaggcttctcccccgaggactacgatctaaccgacccagccaacaacgccatcatctcacccaatttataccgcgtacagacagtgtcagtaggggactaccggttccgtcaccacctagaaactacggtcgaagacaacgaaaaattacgcgacatagcctggaaacgcattggaccctcaggccttgtcggtgccgtaaaagtacgtatagataacctaggccgcatcctagccgtgggcgagtacgattga

SEQ ID NO: 6733 - RNA, 4179 nt, synthetic construct
  misc_feature 1..4179: note = Cas9 variant
  source 1..4179: mol_type = other RNA
atggaaaacaagaactactcaataggcctagacattgggacaaacagcgtcggctgggccgtcatcacagacgactacaaagtcccgagcaagaaaatgaaagtctttggcaacacagacaaacacttcataaagaaaaacctcatcggcgcgctactcttcgacgaaggagccacagcagaagaccgccgactcaaacgcacggcccgaaggcgctacacccgcagaaagaaccggttaagatacctacaggaaatcttctccgaagagatttcaaagctcgactcatcattcttccaccgactagacgactcatttctcgtacccaaagacaaacgaggctcgaagtacccaatctttgctaccctcgaagaggagaaggaataccacaagaaatttccaacgatatatcatctgcgaaaacacctggccgacagcaaagaaaagacggacctcaggttaatatatctcgccttggcccacatgatcaaataccgaggccacttcttatacgaggagtcctttgacataaagaacaacgacattcagaaaatattcaacgagttcatatcaatctatgacaataccttcgaaggaagcagcctgagcggtcaaaacgcacaggtggaagcgatcttcaccgacaaaatatccaagagcgcaaaaagagaacgggtcctgaagctgttctcagacgaaaagtccacgtccctcttctccgagttcctaaaactaatagttggtaaccaagcagactttaaaaagcactttgacctcgaagaaaaagcaccacttcaattctccaaagacacctacgacgaagatctagaaaaccttctgggacaaatcggggacggattcaccgacctattcttggtagcaaagaaactgtacgacgccatactgctatcgggaatcctaaccgtcacagatccctcaaccaaggccccattatccgccagtatgattgaacgatatgaaagccaccaaaaagatctagccgcactgaagcaattcatcaaaaacaacctcccgaaacgttacaacgaagtcttcagcgaccaatcaaaagacggctacgctggatatatagacggaaagaccacgcaagaagcattctacaaatacatcaaaaatctactaagcaaattcgaaggggcagactacttcctcgataaaatcgagcgcgaagacttcctccggaaacaacgcacctttgacaacgggtccatcccccaccaaatacatctccaggaaatgaacgcaatactgcgccgacagggcgaacattacccgttcctcaaagaaaaccgtgagaaaatcgagaaaatcctgaccttccggatcccctactatgtcgggcccctcgcccggggaaaccgcgacttcgcgtggctcacacggaactctgaccaagcgatccgaccctggaacttcgaagaaatagtggataaggcttcctcggccgaagagttcattaacaaaatgaccaactacgacctatacctacccgaagaaaaagtcctaccaaaacactcactcctgtatgaaacctttgccgtgtacaacgaactcactaaagtcaaatttatagccgaaggactgcgagactaccaattcctagacagcgggcaaaagaaacagatcgtcaaccagctattcaaagaaaaacgcaaagtcacagaaaaggacatcatccactacctccacaatgtagacggatacgacggcatcgaactgaaaggtatcgagaagcaatttaacgcctccctcagcacgtaccacgacctcctaaagataataaaggacaaagagttcatggatgacccaaagaatgaagaaatactcgagaatatagtccacacactgaccattttcgaagaccgcgaaatgattaaacaaaggctagcccaatacgactcgatctttgacgagaaggtcatcaaagccctcaccaggaggcactacaccggctggggaaaactcagcgctaaactaataaacggcatctgcgacaaacaaaccggcgacaccatcctagactacttaatcgacgacgggaaaatcaatcgtaacttcatgcagcttataaacgacgatggcttatcattcaaagagatcattcaaaaagcccaggttgtcggcaaaacagacgatgtcaaacaggtagtacaagaactgccgggatccccagcgattaagaaaggaatcctccaatccataaaaattgtagacgaattggtcaaagtaatgggctacgcaccagaaagcatagtgatcgagatggcgcgggagaaccaaacgacagctcgcggcaagaaaaacagccagcaacggtacaagcgtatagaagactcactcaaaaacctcgcccccggtctagactccaacatccttaaagaaaacccgacagacaacatccaactacaaaacgaccgacttttcctctactaccttcagaacggcaaggacatgtacacgggcaaaccactggacatcgaccagttgagttcctacgatatagaccacataatcccccaggcgttcatcaaagacgactccatagacaaccgagtactcacctcctccaaggacaaccgcggcaaaagcgacaatgtcccatccctggaagtcgtgcagaaacgcaaagccttctggcaacaactacttgacagcaagctaatcagcgaacgaaagtttaacaacctcacaaaagcagagagaggcggcctagacgaacgagacaaggtcgggttcatacgacgtcagctggtagaaacccgacaaataaccaagcacgtagcacaaattctagacgccagttttaacacagaggtcaacgaaaagaatcagaagatccgcacggtcaagatcataacactcaaatctaaccttgtgtcaaattttcgcaaggagttcgaactctataaagtccgtgaaatcaatgactatcaccacgcccacgacgcctacctgaacgccgtagtagccaaggcgatcctcaagaaatacccgaaactcgagcccgagttcgtctatggcgactaccagaaatacgaccttaaacgctacatctcgcgcttcaaaccgagcaaagaaatcgaaaaagccactgaaaaatacttcttctacagtaacttgctcaactttttcaaagaagaagtccactacgccgacggaataattgtgaagcgggaaaacatcgagtacagcaaagatactggagagatcgcctggaacaaagaaaaagactttgccaccatcaaaaaggtgctgagctatccccaagtcaacatagtcaaaaagaccgagattcagacccacggacttgacagaggaaagcccaaggggctatttaactcaaaccccagccccaagcccagcgaggactccaaagaaaacctagtaccgatcaaacaggggctcgacccacgcaaatacggcggatatgccggaataagcaactcgtacgccgtactcgtgaaagccatcgttgagaaaggagcaaagaagcaacaaaagacgatcctcgagttccaaggcatctcgattctggacaagataaacttcgagaacaacaaagaaaattacctactaaagaaacggtacatagagatactgagcacaataacactccccaaatacagtctcttcgagttcccagatggcacgaggcgtcggctggcatccatcctatctacgaataataaaagaggagagatccacaaaggtaacgaactcgtgctgcccggaaaatacaccacacttctataccatgcgaaaaacatcaacaagaaactcgaacccgagcacctagaatatgtcgaaaaacacagaaatgacttcgcaaaattactagaatgcgtactcaatttcaatgacaaatacgtgggagcactgaaaaacggcgaacgcatccgacaggccttcacagattgggagaccgtcgacatcgaaaaactatgtttctccttcataggcccagaaaactcaaagaacgcagggctattcgaactaacttcgcaggggtccgcatccgactttgagttcctgggcgtaaaaatcccccgataccgcgattacgcgccctcctccctactgaaagcaacactaatccaccaatccataaccggactatacgaaacccggatcgacctatccaaactcggcgaagactga

SEQ ID NO: 6734 - RNA, 4179 nt, synthetic construct
  misc_feature 1..4179: note = Cas9 variant
  source 1..4179: mol_type = other RNA
atgaataataataactatagcatcgggctcgatatcggcacgaacagcgtcgggtgggccgtaataaccgacgactacaaggtacccagcaagaagatgaaagtgctgggcaacacagacaagcattttatcaagaaaaacctaatcggagctctactcttcgacgaaggagcaacagcggaagaccgaaggttcaaaagaactgcgcggcgacggtacacccggcgcaagaaccgcctccgctatctgcaagaaatcttctccgaagagatgtcaaaggtcgactcgagcttcttccaccgcctcgacgactcgttcctggtcccagaggacaaaaggggctcaaaatacccgatattcgccactttagcggaggagaaggagtaccacaagaagttccctaccatttaccacctccgcaagcacctcgccgacagcaaagaaaagacggacctgcgcctcatatacctagcactagcccacatgatcaaataccgtggacactttctctacgaagaatctttcgatataaagaacaacgacatccagaaaatattcagcgagttcatcagcatctacgacaataccttcgaagggagcagcctgtctggccaaaacgcccaagtagaagcgatcttcactgacaagataagcaaatcggcaaagcgtgaaagaatacttaagctgttcgcctacgaaaagtcgaccgacctattttccgagttcctcaagctcatagtaggaaaccaagccgatttcaagaaacacttcgacctcgaggagaaagcaccactacagttcagcaaagacacttacgacgaagatctcgaaaacctactcggccagataggagatgacttcgccgacctgttcctagtagccaagaaactttacgacgccatattactatccggtatcctgacagtgaccgactccagcaccaaagcccctctctccgcgagtatgatagaacgatacgaaaaccaccaaaaagacttggccgccctaaaacaattcatccaaaacaacctacaagaaaaatacgacgaagtatttagcgaccaatcgaaagacggatacgctaggtacatcaacggtaaaaccacccaggaggctttctacaagtacatcaaaaatctactgtctaagttcgaaggttccgactacttcctggacaagatagaaagagaagattttctacgaaaacagcgtacattcgacaacggttccatccctcaccaaattcacctccaagaaatgaacgcaatcatccgtcgccagggagaacactatcctttcctcaaggagtacaaggagaaaatcgaaaccatcctaacgttccgcataccgtactacgtaggaccgctagcacgggggaatagaaattttgcatggctcactcgtaactcagaccaggctataagaccgtggaactttgaagaaatcgtagaccaagcctccagcgcagaggagttcatcaacaaaatgaccaactacgatctatacctccccgaagagaaggtgctccccaaacacagcctgctatacgaaaccttcgcagtctataacgaactaacgaaagtcaaattcatatccgaaggactccgcgactatcaattcctcgattcgggccaaaagaaacaaatagttaaccagcttttcaaagagaaacgtaaagtaacggaaaaagatatcatacaatacctgcacaacgtcgacggctacgacggaatagagctaaaaggcattgagaaacaattcaatgcgagcctgtccacctaccacgacctcctaaagatcataaaagacaaagagttcatggacgatcccaagaatgaggagatactcgagaacatagtacacacgctaactattttcgaagacagggaaatgatcaagcaaagactggcccagtacgcaagcatcttcgataagaaagtcataaaagctctaacccgccgccactacacagggtggggaaagctcagcgccaagctgatcaacggcatctgcgacaagaaaactggcaaaacgatactagactacctcatcgacgacggatacagcaaccgcaacttcatgcaactgatcaacgacgacggcctgagcttcaaagacatcatccaaaaagcccaagtggtcggtaaaactaacgacgtcaaacaggtagttcaagaacttcccgggtcacccgccatcaagaaagggatcctacaatccatcaaacttgtcgacgagctagtcaaagtaatgggtcatgcaccggaatccatcgttatcgaaatagcaagagaaaaccaaacaacagcgcgcggcaagaaaaacagccagcagcgctacaaacggatcgaagacgcactcaaaaatttagccccgggactcgactctaacatattaaaagaacacccaacggacaacatccaactgcaaaacgatcgactattcctgtactatcttcaaaacggtaaagacatgtacacaggagaagctcttgacatcaaccaactctcgagctacgacatcgaccacatagtccctcaggctttcatcaaagacgactcactcgacaatagagtactaacatcatccaaagataaccgcggcaaatccgacaacgtcccaagcctggaagtagtgcaaaagcgaaaagcattttggcaacaactactagacagcaaactcatatccgaacacaagttcaacaacctaaccaaagccgaacgaggaggcctagacgagcgtgacaaagtaggattcatcagacgccagctagtcgagactaggcaaattacaaaacacgtagctcaaattctcgacgcacgattcaacactgaagtcaacgagaaagacaaaaagaacaggaccgtcaaaatcatcaccctcaaaagcaacctcgtaagcaatttccgtaaggagttcaaactttacaaagtcagggagataaacgactatcaccacgcccacgacgcatacctaaacgccgtcgtcgccaaagcaatcctcaaaaagtaccccaaactcgaaccgggcttcgtctacggcgactaccagaagtacgacataaaacgctacatctcccggtcaaaggacccgaaagaggtcgagaaagccacagaaaaatacttcttctactccaacctactgaacttcttcaaggaagaagtacattacgcggatggaacaatcgtaaaacgcgaaaacatcgagtactcaaaggataccggggagatcgcatggaacaaagaaaaggacttcgccacgatcaagaaagtactcagcctcccacaggtcaacatagtcaagaaaaccgaaatccagacccacgggctggaccgaggcaaacccagaggactatttaactcaaacccatccccaaaaccaagtgaggaccgcaaagaaaacctggtaccaattaaacagggcctcgacccacgcaaatacggcgggtacgcaggcatctccaactcatacgctgtactcgtcaaggccattattgaaaagggcgccaaaaagcaacagaagacagtgctcgagttccaaggaataagcatcctggataaaatcaactttgagaaaaacaaggaaaactacctgttagaaaagggatacataaagatcctatcgaccattaccctcccgaagtattccctgttcgagttcccagatggaactcggagacggctcgcatcaatacttagcacgaacaacaagcgcggcgaaatccacaaaggcaacgaattggtgatacccgaaaagtacaccaccctgctgtaccacgccaagaacataaacaaaactctagaacccgaacacctcgaatacgtggaaaaacaccgcaacgacttcgccaaacttctcgaatatgtcctcaacttcaacgataaatacgttggagccctcaaaaacggagaacgtataaggcaagcattcatcgactgggaaacagtcgatatcgagaaactctgcttctccttcattggcccccgcaacagcaaaaacgccggcctgttcgagctgacaagccaaggatccgcttcggactttgagttcctcggagtgaaaataccaagataccgagattacaccccgagctcattgctcaacgcaacgctaatccaccagagcatcaccggactctacgaaacgcggatcgacctgtcaaaactgggagaagactga

SEQ ID NO: 6735 - RNA, 4179 nt, synthetic construct
  misc_feature 1..4179: note = Cas9 variant
  source 1..4179: mol_type = other RNA
atgaaaaattaccacatcggcctggacatcgggacgtcaagtgtgggattcgcagctcgcgacgacgaaaacaaccttatacgcgtcaaaggtaaaaacgtgatcggagctcgcctgttcgctgagggaaaaaccgcacaggaaaggcgcatggcgcgtacctcaaggcgacgatataaccgtcgaaaatggcgcctccgcctcctaaacgatatctttcacgacgaaatcgtgcacaaagacaaagacttctttaaccgactaaaacagtcttcaatatcccccaaagacgacagaaagaaatacttcggatcgctcctttttcctgagctaagcgattccgagttctaccacaacgggaatcaaaccatctatcacctccgccaccgactcatgacatccaacgaaaaagccgacatacgagagatctacctcgccctcagacatatagtcaaataccgcggcaatttcctcgacgatactcctgtgtctagcttcgaggcttctgacctcaaactcgggtcgttcatacctaccctaaacgacctcttcgaaaccatcgacgtgaactacgtctttaactcagaaaacaccaaccaaatcgaaagcatcctactcaataacgacctccgcaactcggacaaatcaaaacagctggtggacctcctgtaccgcaacgtgagcgacgtagacgacaaatccctagaaaaacaattcaataaattccgtaaggacatcagcaaagaaatagccaaatccttcgttggaagcaaattcaacgtaaacaagctattagcctacgagaccgacgacggatctaagatctccctcagcttctctgacgcttcctcggacgacaaaatgctcgagctagcagacaacctagacgacgaacgcattaacatactcaacgccctcaaggtaatctactcgagggtccgactcaaccaaataatcccaaacggcatgggcctctccgaatccatgatagcgagctatgaactacacaaaaagcaactgaacgatctaaagaaactcctaaacgtactacccttccacgagaaatacgccgtcaaagtcgcgtacgccgcctacatcggcaacatggatgcccaaaaattcactcaggcagaactgtcaacaatagagagcctcaaagagaaggactccatcaagaaagtcatcgattgcaaaaccggacatatcaccaacgagtctctgatatccgttatcaaccaaatcgtcgtgaacccctacctcgaaaacagcgacttcgaactaatcgacatcgtcaagaaaatcgatcaggacatcaaaaacggggaatacctcctcaaacaacgcaacaaccaaaacggcaacatcccccaccaactacatcaaatggaaatggaccaaataatcgaaaaacaatcgaaatactatcccttccttggcgaactcaatccgaatgagaacaggcgccatatcgctaaatacaaaataagcgaactcgtggccttccgggtaccgtattatgtgggtccccttatcacccccgaggagcaagccaaaacctccggcgcgagcttcgcctggatgaagcgaaaagaagatggcgagatcacaccctggaacttcgaccaaaaagtggacagagaagctacagcgagccgctttataaagcgcctgaccgtcaaggacacttatctattcaacgaggacgtcctccctgacaatagccttttatatcagcagttcaaagtcctaaacgaactcaacgtcgtaaaagtaaacaacaagcgcctaagccaagctgagaaacaaggggcttttaacgacctattcaaagtgaccaaaacagtcaccgcgaaacgccttaaaaactatcttgtatccaacttcaaccacctagacactatcgaaatcacaggtctctccgacggagaaaaattcaacaacggcctcacctcctacgtagatttccagaaaatattcggcgacaaaataaacaacctcgaactaatggacgatttcgagtctctcatcgaatggagcacggtcttcgaagatcgccatatcttcgaagaaaaagtgcgcaacgaaataaactggatcagcgagtcggagctcaagcaactcgtagcgaaacgatattccggttggggcagactctcctccaaactcctcgtcggcattaacaacgacgaaggccgcaacataatcgagcaactattcgagacgtccgaaacattcatggaggcaatctcccgccccgaggtgaagaaacaaatcgatgagattaactctgacttcatcaaaaacactgacatagaatcagttctggcagacgcatacacctcgccccaaaataagaaagccatccgcgagacctacaaaatcgtcaaggacatccaaaaagctatgggcggcaaggctcccgaatccatctccatcgagttcacccgaaacccggaagacaagggcgaactaacccgctcccggcattccgaaatctcaagaaaatacaaggaactgagcaaggaaatttcgaaggaattaaacgacgagctcaaaagcaagaagaactctatggacatcgacaagtactatctctacttcatgcaaatgggaaaagatctctacgacggcaaatccatagacatcgacgatctaaataactaccaaatcgaccacatagtcccgcagagcttctacaaggacgactcctttgacaaccgagtactaacctactacacgaacaaccaaaagaagggcaacaacacacccctcaatggacttaacatcagcaatgaaacgcgaaaactgtggtcccacctccacgacttaggcctaatatccaaacgaaagtacctcaacctaacgatgcaaggcttagacagcctatccaaatatactaaacacggttttatccgtcgacaacttgtcgaaacctcccaagtaatcaagctcgtcgccaacatcctgtcggacgaattttccgcggacaacacaaaaatcatagaagtcaaggccaaaatgaacagccagatgcggcactcctttaacctgtataagatccgcgaactcaacgattatcaccacgcattagacgcctatctcaccacattcatcggcggctacctctacaaccgatacccgaaactccggggtatgttcgtatacggggatttcaagaaattcgatgtcaacgatgccaacaacgtaaaaaccctaaacttccttcacgacataaccaacccttcagataaatttgtaaaccagatttacgatgaacaatccggagagcttatcctcgaccgcaaacacgccattgaaacaataaagaaaatataccaatacaaattcatgctaataactcgggaggtctcgaccaaagacgacaagctctccgaccaaacggtatattccgcaaagcgtatcaataacgtcgcgtcaccgatccccgtgaagaaagactccaacccagagctatatggatttagaaccggcaatgtggaccaccacatggtgatcgtgaaatatcccaagaaagacagctttgtatacaaagtggtcgggattcccatcagattcatgcaggaactacgatcatcgaaaaaccaatcagaatacgaaaatacgctaaatcaaatcgtccaggccaaacttaacaggaaaaagttcgacttccgcgtcgtcgtcgataacgttatgtacgggcaattaatccaagacggcggccaaaagttcactctcggctcctccacctaccgctacaacgccaaacaactcgtactcgacatggacagcctgcggatactctcagacgaaaagtaccgtaactccctaacagatgatgagaaaaattccgagttcatcaacatctaccaacaagtcttaaacgtcgtcaacgaaaaatttgacgtttttgacgtccgcggcacccgagacaagctcaccaaaggcctggacaaattccttaacatcacatcaaacgacaaggaaattgtcctcctcaaaattctttcaggactacactgcaatgccgcccgggttaagataaacgaaataggtatcaacactagcttcggcgagctccagaccacccacggcatagtacttagcgaaaactcctacataatatatcagagcccatcgggactttttgagcgaaaggtacgactcaaagacctgtga

SEQ ID NO: 6736 - RNA, 4179 nt, synthetic construct
  misc_feature 1..4179: note = Cas9 variant
  source 1..4179: mol_type = other RNA
atggccaacaaaacgtggtacctaggtctcgacatcggatcggccagcgtaggctgggccgccacagacaccggctataaaataatacggaaaaataaaaagcgcctctggggcgtccgcctattcgaagaagccaagaccgcagaagaccgcaggggatatcgctccagccgccggcgactcgcccgaagaaaatggaggctgaacctcctcgaggaactcttcacgtcggaagtgaagaaagttgacgaaaatttcttcctgcggctcaaagaaagccagtaccactatgaagataaaactcacaaagtcccctacgccatcttcaacgataaagattacaccgataaagactactacaaggactaccccaccatctaccacctacgaagcaaactcatgaccgaggaaaaccccgacattcgcaaagtgttcctggcaatccaccacatcatcaaaaaccgcgggcacttccttctccaaggccaatcgttcaaagacggcaacttaaacaacctcataaaggagctactagagctcgacatactacatgtaggattcgaggtgacggaagaagtcgtcgacaaaatcgcagacatctcactggagaagaagacctcaaaggacaaactaaacgacataaaagaactataccctaaagagaaacaattactcgaggtcttccgcctcattttcggcggaaagacatcgctggacaagctattcgcgatagacgaatacaaggagctagacgcagcaataaagtctgtctccttcaaagagaaaatctacgaagaggtccgccacgactatgaacaggtgctctccaactacatagaactactggacctcgcaaaactcgtatacgattccataatcctgtccgacataaagaaagaagggaaaacactcagcgaatccaaagtggaattattcgaaaaacaccgagacgacctcctaaagctcaagaacctagtaaagaacgatagcaagctcagcgaggacaaaaaggtcgagttatacgccctcatcttcaaagaagacaaagacaaggggacgaactatgtcaactacatacgcaagtcagaggagggcaaaggctgcaactacgaagatttcaagaaattcctagtaaaagaactagcgaaactggaagaatcctctgtcaaaacggaaataatcaaagacctggagctagaacagttcctcccacttcaacggacaaaggacaactcagtggttccataccaaatccacaaagaggaacttgtgaagatcctggataacgcagcgcgatatcacagcttcctcaatgaaaaagacgagagcggatacaacgtcagagagaaagtcatccagctactggagttccgcataccatactatgtcggccccctaaactccagcaaaaaggcaaaagaaggaggattcgcatggtccgttcggaacaccggttatgagaacacccccgttaccccctggaactactccaaagtaattgacgaatcagcctccgcagaaaaattcattacgaacctcaccaacaaatgcacatacctcaaaggagaagacgtactccccaagtcgagtttactctatagcgagttcgcactcctaaacgaactaaacgccctcaagtacgacggtaaccgcatcagcctggaagcccgaaacactataatcgaaaaactgttcaagcaacaaggcaagaaagtcaccaaaacatctatcaaaaacctactcaaagctgaaggctatatagacggaaagggcgaaataacgggcatagatattacagtgaagaacgacctgaagtcataccgcgactttaagaaaatactcggaaacaaattcaatagcgaacacgtcgaaaatataatcctctggatcactctatacggcgaatcgcgaaaactaataaaagccaagatagagtcggtctatggcgaagtctactcgaaagacgaaataacaaagatgtcccgcctagtatataaggactggggtaggttctccagaaagctgctgacagagctagtaagcaagaaactttacaacgaagaaactggagaatgcctaaacattatcggcgccatgcgccaaaataacatactattcatggaactactcgcagaccgattcgactacagcaaacaaatcgtggagttcaacaaagaacttcaagaagacgtcacagaaatcgccccggagatcctcgacgacctctacgtaagcccagcggtaaaaagatcgatctggcagacagtccgaatcgtggaagaactaaagaaaataatcggatgcgcgcccgccaaaatcttcgttgaaaccacccgctcgaaccaagagaagaagaaaccaacagactcgcggaagaaacaactcgagctcgcctacaaagcggtcaaaaaggacgtcaaggagctagaaaaagaaatcgggacgatcaacttcgacgtactgaacgatcggctcagctccgtagagcccagcaagttgaaggcaaagaagctgtacctatactatacacaacttgggaggtgcatgtactccgaggaaccaataaacatttcggagctgtttgacaacaataaatacgacatcgaccacatctacccacaaagtaagatcaaagacgacagcttcacgaatacggtgctagtgaaaagggagtcaaacgctgccaagactgaccggtaccccctaggctccgacatccaaactcccagcaacagaagattctggaaattcctaaaagagaaaggactaatttccgatgagaagtacaaccgcctcgtgcggaccgaagagttcagcgatgaagaactaagcggcttcatagcgcgccaacttgtcgagactagccaatccgtcaaagccgtagcctcaatcctaggagagctcaacccagagacctccatatgctacagcaaagcagagaacgtcagcagcttccgccagaacttcggaaagatcaagaagggggaccgagactctaaaaacaacgaccaactcatcaaagtcagagaaataaatgactaccatcacgctaaagacgcctacttaaacgtcgttgtggggaacgtatacgatacaaaattcaccaggaatgttttcaacttcataaaggacaagaaggacggccgcaagtactcgcttaacaaggtattctacgaaaacgtcagcgacagcaagaccgtagcctgggagatggataagacgatacaccaagtcgagaaggtcatgaacaataacaacataatggtcacccgccgcacgtcagagcaaaaaggcggtctcttcgacgccacagtttacaaagctaaagttgcagcaaaagccaaagacggagtgtactaccccttaaaaacgagcaactcggtggtaaaggacgtcgccaagtacggtggctacaccagcatcggcattgcatattacagcatcttcgaatacacgatcgttaacaagaagggcgaagagaaaatcacgagaataatcccaataccgatctatataagccagaacattaaggacagcacagcactgatagagttcggtaagtcacagatcttctgccgtgcctacgagaaaatcaaagactttaaactgctgtaccggaaactatgcatcggcagcaaaattaacataaacaactaccagtactacatcggcggtaagagcgacgaacgattctactacgactcagccatacaagtaacactcgacaagaaaagcgaaaaatacctcaagatcctatcgaaataccaaaattggaagaaagaaaacaaagacggcgaactctgggaaaacatcacaaaagaaaacaacatcgaactttataataaactggtagagaaaatgaactccgaaattttcacgaaaaagaagagtaacaaatataacgaactcaactcggaggaaatacgaaacaatttcatcaaaatatcggtcgaggaacaagcgaaagtactccttgaaatactcaacctcctaacaaacaaaaagagcatctttgacctaaagtccatagacataaaagcagcacgcggcaagatcagctttaacttgacctcattaatccagttcagcatcatcgaacaatcaataacaggattctacgaaaaagagatcacgataataggagataaaggcaacgatatggaaaacaacaacagctga

SEQ ID NO: 6737 - RNA, 4179 nt, synthetic construct
  misc_feature 1..4179: note = Cas9 variant
  source 1..4179: mol_type = other RNA
atgaacaataacaactacagcataggcctcgacataggcacgaactccgtcgggtgggcagtaatcaccgacgactacaaggtcccaagcaagaaaatgaaagtcctcggaaataccgacaaacacttcattaagaaaaacctcattggcgccctcctgttcgacgagggaacaacagccgaggaccgccgactaaaaagaaccgccagacgcaggtatacacgaaggaaaaaccgccttcggtatctacaagagatcttctcgcccgaaatttccaaggtcgacagctccttcttccatcgcctagatgactccttcctagtacctgaagacaaacgcggatctaaataccccattttcgcaaccctagctgaagaaaaagaataccacaaaaactttcccaccatctaccatctgcgcaagcaactcgctgactcaaaggaaaaggccgacctccgacttatatacctcgcactagctcacatgataaaataccgcggccactttctatacgaagaatcgttcgacatcaaaaacaacgacatccagaaaattttcaacgagttcatcagtatttacgacaacacctttgaaggcagctcactttccggccaaaatgcgcaagtggaagcaatcttcaccgataaaataagcaagtccgcaaagagagaaagagtcctaaagctattccccgacgaaaagagcacggggttattcagtgagttcttgaaactcatagtcggcaaccaagccgagttcaaaaagcatttcgacctagaagaaaaagccccacttcaattctccaaggacacctacgacgacgacttggaaaaccttctcgggcagatcggagacggcttcgccgagctattcgtcgccgccaaaaagctatacgatgccatcttacttagcggaatcctcaccgttacagacccgtcgaccaaagcaccactttcagccagtatgatagagcgctacgaaaatcaccaaaaagacctcgcggcgcttaaacaattcatccaaaacaaccttcaagaaaaatacgacgaggttttcagcgaccaatccaaagacggatacgcaggctacatcaacggcaagacgacgcaggaagccttctacaagtacatcaaaaacctccttagtaaattcgagggatccgactacttcctggacaaaatagagcgtgaagatttcctaaagaaacagcgcacttttgacaacggctccataccacaccaaatccacctccaagaaatgaacgccatcattcgtcgccagggcgagcactaccccttccttcaggaaaacaaagagaaaatcaagaaaatcctcacgtttcgaataccgtactacgtcggcccgctcgcgcgcggcaacggcgactttgcctggctcactcgaaattccgaccaagccatccgaccgtggaacttcgaggagatcgttgaccaggcatcgtcagccgaggatttcatcaacaaaatgacaaactacgatctatatctccccgaggaaaaagtcctacctaaacattccctgctctacgaaacatttgcagtctacaacgaattaaccaaggtaaaattcatagccgaagggcttcgcgactaccaattcctcgactccgggcaaaagaaacaaatcgtcaaccaactgttcaaagagaaaagaaaagtcacagaaaaagacattactcaatatctacacaacgtcgacggctacgatggtatcgaactgaaggggatagaaaaacaattcaacgcatcgctatccacctaccacgacctgctgaaaatcatcaaagacaaagcattcatggacgatgcagaaaacgaagccacactcgagaacatcattcacacactcaccatcttcgaggacagagaaatgatcaagcaaaggctcgcccaatatgactcactgttcgacgaaaaagtcattaaagccctcatcagaagacactacacaggctgggggaagctatcagccaaacttataaacggaatatgcgacaagaaaaccggaaaaaccatactcgactacctgatagacgacggctacagtaaccgcaatttcatgcagctgatcaacgacgatgggctctcattcaaagacatcattcagaaagcgcaagtggtcggccgcaccaacgacgtcaaacagatagtccatgaactccccggatccccagcaatcaaaaagggcatactccagtccatcaaaatagtcgatgaactcgtaaaaatcatgggccacacccccgaatccatagtgatagaaatggcgcgcgagaaccagaccaccgcccgaggcaagaaaaatagccaacagaggtacaaacgaatcgaagatgcgctgaaaaaccttgcgccaggccttgactccaacattctgaaagagtaccccacggacaacatccagctccaaaacgaccgactcttcctctactacctacaaaacggaaaagacatgtacacaggcgaaccccttgatatcaaccaactgtctagttacgacatcgatcacatcgtcccccaagccttcattaaagacgactcactggacaaccgagtgctcacaagctccaaggacaaccggggcaagtccgacaacgtcccatcactggaagtagtacaaaagcgtaaagccttctggcagcaactactagactcaaagctaatttcggaacgaaaatttaacaacctaaccaaagcggaaaggggtggcctcgacgagcgcgacaaagtaggattcatcaggcgccagctcgtcgaaacgagacaaataaccaaacacgtagcacagatcctcgacgccaggttcaacacggaagtcaccgaaaaagataagaaaaacagaaatgtcaaaatcataacgctcaaaagcaacctcgtcagcaacttcaggaaagagttcaaactgtacaaagtccgagagatcaacgactatcaccatgcccacgacgcctaccttaatgccgtggtggcaaaggccatactcaagaaataccctaaactagaaccagagttcgtatacggagactatcaaaaatacgacctaaaacgctacattagccgctcaaaagaccccaaagatgtcgaaaaagctaccgagaaatacttcttctattccaacctcttaaacttcttcaaagaagaggttcactatgccgatggaacgatagtaaaacgcgaaaacatcgagtactcaaaagatactggcgagatagcctggaataaagaaaaagacttcgcaacgataaagaaagtcttatcactccctcaggtcaacatcgtcaagaaaaccgagattcaaacgcacggactagaccgcggcaaacctcgcggcctattcaacagtaacccctcccctaaacccagcgaggacagcaaagaaaatctagtaccaattaaacaagggctcgacccaagaaaatacggcggatacgcgggcatcagtaactcctacgcggtcctggtcaaagcaataatagaaaaaggtgcgaagaaacagcagaaaaccgtgctcgagttccaaggaatatccatcctggacaaaataaacttcgagaaaaacaaagaaaactacctgctcgaaaaaggctacatcaaaatactgtcaacgatcaccctccctaaatactcgctgttcgagttcccagatgggacacgacgacgcctggcgagcatcctaagcactaataacaagcgcggcgaaatccacaaaggcaacgagttggtcatctccgaaaagtacaccacgctcctataccacgccaaaaacataaacaagacactcgaacccgagcacctcgaatacgtagaaaaacacaggaatgatttcgcaaaactgctcgaaagtgtgttagacttcaatgacaagtatgtcggcgccctgaagaacggagaaagaatccggcaagccttcatcgattgggaaaccgtcgatatcgaaaaactatgcttctccttcattggcccacgcaattccaaaaacgctggcctattcgaactaacctcacaagggtcggcttctgacttcgagttcctcggcgtaaaaatcccccgctacagagactacactccctccagtctgctcaacgccacgctcatccatcaatccattactggactatatgaaaccaggatcgacctatccaaactaggcgaagactga

SEQ ID NO: 6738 - RNA, 4179 nt, synthetic construct
  misc_feature 1..4179: note = Cas9 variant
  source 1..4179: mol_type = other RNA
atgaacaataacaactactcgataggcctcgacatcggcacaaattccgttggctgggcagtcatcacggacgactacaaggtgccctcaaagaaaatgaaagtcctaggaaacaccgacaagcacttcatcaaaaagaatctcataggcgcccttctgttcgacgaaggcgcaaccgccgaagaccgccggttcaaacgcaccgcacgtcgacgatacacaagaagaaagaaccgccttcggtacctacaggagatcttcagcgaagaaatgtccaaagtcgacagctcgttctttcacaggctcgacgattcattccttgtcccagaagacaagcgaggcagcaagtacccaatatttgctaccctcgccgaggaaaaagaataccacaagaaatttcccacaatctaccacctacgaaaacacctggccgactccaaggagaaaaccgacctgcgcctaatctacctagcacttgcccatatgatcaagtaccgaggacatttcctctacgaagaatcattcgacatcaagaacaacgacatacagaaaatcttctcggagttcatctcgatctacgacaacacgttcgaaggctcaagcctctctggccaaaatgcacaagtggaagccatattcaccgataaaatcagcaaatccgcgaagcgggaacggatcctcaaactcttcgcatacgaaaagtccaccgaccttttctccgaatttctaaagctaatagtcggaaaccaggccgatttcaagaagcacttcgatctagaggaaaaggcgccgctccaattctctaaggatacttacgatgaagacctcgagaacctactcgggcagatcggagacgatttcgccgatctcttcctagtcgcgaagaaactatacgatgccatcctactgagcggaattttaaccgtcaccgacagctcaaccaaggcacccctctccgcttccatgattgaaagatatgaaaaccaccaaaaagatcttgctgcactaaaacagttcatccagaacaacctccaggaaaagtacgatgaagtcttcagcgaccaaagtaaagacggatacgccagatacatcaacggtaaaaccacacaagaagccttctacaagtacattaaaaaccttctctccaaattcgaaggctccgactacttcctggacaaaatagagagggaagacttcctccggaaacagcggacctttgacaacgggtcgatcccacatcaaatacacctccaagaaatgaatgccatcattagacgtcaaggcgaacactaccccttcctaaaagaatacaaggagaagatagaaacaatcttgaccttccgaatcccctactacgtcgggccactagccaggggtaaccgcaacttcgcctggctaacccgtaacagcgaccaggccatacgcccctggaacttcgaggaaatcgtcgaccaagcctcctccgccgaggagttcatcaacaagatgacgaactacgacctttacctaccagaggaaaaagtactccccaagcactccttactatacgaaacctttgcggtatacaacgaactcacaaaagtgaaattcatctccgaaggcctacgtgattaccaattcctagactccggccaaaagaaacaaatcgttaatcaactgttcaaagagaaacgaaaagtaaccgaaaaagacataatccagtacctccacaacgtagacggatacgacggtatagaactcaaagggatcgagaaacaattcaacgcgtcacttagtacctaccacgacctcctcaaaataattaaagacaaagagttcatggacgacccaaagaacgaagaaatactagagaacatcgtacacacactgaccatcttcgaagacagagaaatgattaagcaacggttagcccaatacgccagcatcttcgacaaaaaggtcattaaggccctaacccgacgccactacactggatggggcaaacttagcgctaagttaatcaacggcatatgcgacaagaaaacgggcaaaactatactggattacctcatagacgacggttattcgaacagaaacttcatgcagctcattaatgacgatggtctatccttcaaagacatcatccagaaagcacaagtggtaggtaaaaccaacgacgtgaaacaagtcgtccaagaactaccgggttcccccgccatcaaaaagggtattctacagagcataaagctggtcgacgagctagtcaaggttatgggacacgcccccgaaagcatagtcatcgagatcgcgcgcgaaaaccagaccaccgcgcgcggcaagaaaaactcccaacaacgatacaaacgaatcgaggacgccctcaagaacctcgccccagggctggactccaacattctgaaagaacaccccacggataacattcagttgcagaacgaccgactcttcttatattatctgcaaaacggaaaagacatgtacacgggcgaagccctcgacataaaccagctatcatcctacgacatcgaccacatcgtcccacaagcattcatcaaggatgacagcctagataaccgcgtactaaccagcagcaaggacaaccgaggcaaatctgacaatgtccccagccttgaagtcgtccaaaagagaaaagcattctggcagcaactcctcgacagcaagctgataagcgaacacaaattcaacaacctaactaaagcagagcgaggcggtctagacgagcgcgataaggtcggcttcatccgcagacaactggtcgaaactaggcagatcacgaaacacgtggcccaaatactagacgcacgattcaacaccgaggtaaacgaaaaagacaagaaaaaccgcaccgtcaaaatcattacgctcaaatcgaacctggtcagcaactttcgtaaagagttcaaactctacaaagtacgcgaaatcaacgactaccaccacgcccacgacgcctacctgaacgcggtcgtcgccaaggcaatcttgaagaaataccccaaactagagcccgaatttgtctacggggactaccaaaaatacgacataaaaaggtacatcagccgctccaaagacccaaaggaggttgagaaagcaaccgaaaaatacttcttctactccaatctcctaaacttcttcaaggaggaagtccattatgcagacggcaccatagtcaagcgcgagaacatcgaatactccaaagacacaggagaaatcgcctggaacaaggaaaaagacttcgccaccatcaaaaaggtactctcccttccacaagtcaacatcgtaaagaaaacggaaatccagacccacggattggaccggggaaagccgagaggcctattcaactccaacccgtcaccaaaaccatccgaagaccgtaaggagaacctagtacctatcaagcaaggactagacccgcgaaaatatggaggatacgccggcatatcaaacagttacgcggtcctcgtcaaagcaatcatcgaaaaaggcgccaagaaacagcagaaaactgtactcgagttccaaggaatctccatattggacaaaatcaactttgaaaagaacaaagaaaactacctactcgaaaagggctacatcaaaatcttatccaccataacactccccaaatacagcctcttcgagttccccgacggcacgcggcgacggctagcctcaatactgtccacaaacaacaaaagaggagaaattcacaaaggaaacgaactggtcatcccagaaaaatacaccaccctactctatcatgccaaaaacattaacaaaaccctggaacccgagcacctagaatacgtcgaaaaacaccgcaacgacttcgccaaactattagagtacgtccttaattttaacgacaaatatgtaggagcgctcaaaaacggtgaacgtatccgccaggcgttcatagactgggaaacagtcgacatagaaaaactttgcttttctttcatcggcccccgcaactccaaaaacgccggcctattcgaacttacatcacaaggctcagcgagcgacttcgagttcctcggagtgaagataccgaggtaccgagactacaccccatcctccctactcaacgcaaccctcatccatcagtctatcacggggctatacgaaacccgcatagacctgtctaaactcggagaggattga

SEQ ID NO: 6739 - RNA, 4182 nt, synthetic construct
  misc_feature 1..4182: note = Cas9 variant
  source 1..4182: mol_type = other RNA
atgaaacgcgtgacggaagactacatcctcggcctcgacataggcaccaacagctgcggctgggccgtcacggacaagaaaaacaacctgctaaaactccgcggaaagaccgccattgggtcccatttattcgaggagggccacaccgccgcagaccgcagaggtttccgaaccacccggcgtagactaaaacgccggaaatggagactccgccttctagaggaaatcttcgcggaacccatggccaaggtcgacccaggcttcttcgtacgccttcaccaatcctgggtttcacccctagacaaatcaaggaaaaagtaccacgccatcgtgttccccaccgccaaagaagacaaagcattctatcaaaaataccccacaatatatcacctaagagacgcccttatgacacaagacagacaattcgacctccgcgaaatcttcttggcgatccaccacattgtcaaattcagaggcaacttcctccaagacacacctgtcaaggacttcgaggcgtcgaagatcgaagtaggccccatcctctccaaaatcaacggcgcctttgcggagaagatcgtcgaagaccaagacccaatcgagctcaacgtagcgaacgctgcagaaatagaagccgtaatccgcggcaaagacgccgataaaaccctgtacaaaatggacaaggtaaagaagattgccaaactcctcactgactcaacagcaaaagaggagaaaaacgtagctaaacagatagcgaacgcggtcatggggtacaagacgcaattcgaaacaatactcggaaaagaaatagacaaaagcgacaaagcacaatgggaatttaagctcaccgacggcgacgccgacgataaacttgaagctctcctcccagacctagacgaaaacgaccagacgatcatagcagagataaagaaattgtttagcgcaattaccctcagcaccatcgtggacgagaacaagtcgctcagccagtctatggttgccaaatacaacaagcaccaccaggactacaaactcctcaaagcatacatagacactctgcaggacaggtcgatcgcaaagaaacttctgctcgcctacgacctttacgtgaacaatcggcacgggcgcctcctcgaagccaaaacggagttcaaacaagatggaacccttactaaagaagacttctacaaaaccgttaaggacaacctcgatgactccgagttagcccgaaagatcgcccaaaagatcgctgccgacaacttcatgcccaaacagcgcactaactccaacggcgtaatacccttccaactacaccagatagaactcgacaaaatcattgcaaaccagagcaaatactaccccttcctggcggccgagaacccggtggaggaccaccgcaaacaggcgccgtacaaactcgatgagctagttcgattccgggtcccatattatgtaggacccatgataacacccgacgaacaagagaaaaccagcggcaagagcttcgcttggatggtacgcaaagaagacgggcaaatcaccccatggaacttcgaacaaaaagtagaccgacaagagagcgctaacaaattcataaaacgaatgaccatcaaagacacttacctactcggcgaagacgtactcccggccaacagcttactttaccaacgattcgaggtcctgaacgagctcaacaacatacgcataaacggctcacgaatcagcatcgacttgaagcagcaaatcttcaacgacctattcgaagagaagaaaacagtgacagagaaaagtctcactagctacctgaaacaaaacctacacctcccaaccgtcgaaataaaaggcctcgccgatcccacaaaattcaattcctcactagcatcatactaccatctgaaatccctccacgtattcgacaaggagcttgcagatccccaatatcaaaaggattttgagaaaatcatagaatactcctccatctttgaagataagaagatataccaagataagttgcacgccgagttcaaatggctaacacccgaacaattcaaggccatcagtacctggagactacaaggttggggccgactttcttgccggcttctggtcgaactccacgacacaaacgggcagaacataatggaacagctatgggactcccagaaaaacttcatgcaaatcgtaacggagccggacttcaaagacgccatcgccaaggaaaatcaaaacgtgacccaagtcaacggcgtggaagaaatcctggcggacgcctacacatctcccgccaacaagaaagcaattcgccaagtcgtgaaagttgtggccgacgtggttaaagcagcaggcggcaagaagccagcgcaattcgccatcgagttcacccgcgaccccgacaaaaacccccagctctcccacatccgcggaaccaaactattgaaagcctaccaagaaacagccggcgagctcgtcgaccaaaagctcacggacagtctaaaagaggcaatgaccagtcgaaaactactgaaagacaagtacttcctctactttatgcagaccggacgcgacgcctacacgggcaagaaaatcaacatcgacgaagtcacgactaactaccagatcgatcacatattgcctcagagcttcattaaggatgactccttcgacaacagggttctcacagccactccgctcaacgccgaaaaatccgacgacgtcccctacaaacgcttcgccaacaactacgtatcggacctaaaaatgactgtaggcgaaatgtggaaacactggcaaaaagccggaataataaacaagcacaaactggggaacttactactcgacccggatcgcctgaacaagttccaaaagtctggtttcatcaaccgacaactggtcgaaacatcacaaatagtaaagctagtatccgtaatcctgcaaaacaaataccccgacgctgaaataatcaccgtaaaagccggtgacaacagcgcactccgccaaagactcaacctctacaaatcccgtgacgttaacgactaccaccacgcaatcgacgcctacctctcgatcatctgcgggaactttctgtaccaagtatacccaaaataccgtccatatttcgtgtacggaaaatacaagaaattctcacaggacccagacctccagaaagacctaattaaacacttcaaaggcttcaccttcatgtggcccctcctacagaaggataactccgagcgcaaggcgcccgaggaaataaaagagaataacagcgagcgaatcgtcttctataaacacccggacatattcgacaaattaagaaaggcttacaactacaaatacatgctagtcagccgcgagacgacaaccgaatcaagctcaatgttcaagatgaccatcttcccgcgaggcgagcgcgatagaaagaaaacacggaaactcatccccaaagggaacggccttgacccaaaaatttacggcggatacagcggtaacacagacgcgtacatggttatagtaaaaattgataaagcaaaagaatccatatacaaagtaatcggggtaccgatgcgcgctttgactcgacttaaccaagctaaaaagcaaggcaactaccaagaggaactccaccaagtactagaacctcagatcatgctagacaagaacggcaagcccaaacgaggagtcaagggttttagggtaataaaagaccacgtaccctttaagcaggtcgtgctagacggtgacaagaagtttatgctttattcggcacaatacaagactaacgccaaacagctagccttaagccaggaaacaatgcgcatcgtcacagacaacctgaaaaagggggaagaccaagacaaactactggttaaagcctacgacgaaatactacagaaagtcgactgctacctgtcgctgttcgacaccagcaacttccgcaacggactacacctcggccggaacaaattcatagacctcgaagtcaacgacaagaaaattacactcagcaacattctaaacggccttcacgacaatatggtacttgggaatctcaaaaacattggaatcggaacgccactaggccaaatgcaagaaaaatctggcatcaccctatcaccagaagctgtactaatcttccagtcgccaaccgggctgttcgaaaaacgcgtaaaaattgccgacctctga

SEQ ID NO: 6740 - RNA, 4188 nt, synthetic construct
  misc_feature 1..4188: note = Cas9 variant
  source 1..4188: mol_type = other RNA
atgaagaaagaaataaaagactacttcctcggcctcgatgtaggaaccgggtccgtcggctgggcagtaaccgacaccgattacaaactcctaaaagcgaacaggaaagacttatgggggatgcggtgctttgagacagcagagaccgctgaggtgcgacggctacaccgaggagccaggagacgcatagaacgccggaagaaacggatcaaactcctgcaagaactgttcagccaagagattgctaaaatcgacgaaggcttcttccaacgcatgaaagagagcccgttctacgccgaggacaagaccatcctacaagaaaatgcactctttaacgacaaagacttcaccgacaaaacgtatcataaggcataccccacgatcaaccacctcattaaagcatggatagagaataaggttaaacccgatccccggctgctttacctcgcatgtcacaacatcataaagaagcgaggccacttcctcttcgagggcgatttcgacagcgaaaaccagttcgacacctcaatccaagccctgttcgagtacctacgagaagacatggaggtggacatcgacgcagacagccagaaggtgaaggagatcctgaaagactcaagcctaaagaactccgaaaaacaaagccgactcaacaagatcctgggcctgaagccatccgataaacaaaagaaagcaatcacaaacctcatctcagggaacaaaatcaacttcgccgatctctatgacaatccagacctcaaagacgctgagaaaaactccatcagcttctccaaagacgacttcgacgcgctcagcgacgacctcgcctcgatcttaggtgacagcttcgaactactcctcaaagctaaagcggtatacaattgttccgtcctatcaaaggtcatcggggacgagcaatacctcagcttcgccaaggtcaaaatttacgagaagcacaagaccgacctaacgaaacttaaggcagtaatcaaaaagcacttcccaaacaactataagaaagtgttcggttacaaccaggacaacgaaagcaaaaacaactactcaggctacgtgggagtatgtaaaaccaaaaacaaaaagctagtaataaacaactcagtgaaccaagaggatttctacaaattcctcaaacctatactctccgccaaatccgagatcaaagaagtaaacgacatcctggcggagattgaaaccggaaacttcctaccgaaacaaatctccaaaagtaatgcagaaataccataccaactgcgaaaaatggagctcgagaaaatcctgtcaaacgcagaaaaacacttcagcttcctcaaacaaaaagacgaaaagggcctcagtcactccgaaaagattatcatgctcctcacattcaaaatcccctactacataggaccaataaacgataaccacaaaaagagcttccccgaccggtgttgggtagtcaagaaagaaaaatcaccctccggaaaaacaaccccctggaactttttcgaccacatcgataaggagaaaaccgcagaagagttcatcaccagccgtaccaacttttgcacgtacctgatcggcgaatccgtcctgcctaaaaactcactcctctacagcgaatacaccgtactcaacgaaatcaacaatctgcagatcatcatagatggcaagaacatctgcgataccaaactgaagcagaaaatatatgaagaccttttcaagaaatataaaaagataacccagaaacaaatctccaccttcataaagcacgaagggatatgcaacaaaacggacgaagttattatactgggcatcgacaaagaatgcacctctagtctgaaaagctacatagagctaaagaacatcttcgggaagcaagtcgacgagatatcaactaagaatatgctagaagaaataatccgatgggcaaccatctacgacgaaggggaagggaaaacgatacttaagacaaaaataaaggcagagtacggcaagtattgttcagacgaacagataaagaaaatcctcaacctcaaattcagtggctggggccgcctatcacgcaagtttctggaaaccgtcacgtctgaaatgccaggcttctcggaaccagtaaacataattaccgcgatgagggaaacgcaaaataacttaatggagttactatcttccgagttcaaattcacagagaacatcaagaaaatcaatagcggattcgaggacgccgaaaaacaattttcatatgacggcctcgtcaagcccctgttcctctcccctagcgtcaagaaaatgctctggcagaccctcaaactcgtaaaagagataagccacatcacacaagcgccacccaaaaagattttcatagaaatggccaaaggagccgagctcgaacccgcgagaaccaagacccggctaaagatcctacaagacctatactcctcgtgcaagaacgacgcggacgccttcagcagcgaaatccaatatctaagcggcaaaatcgaaaacgaggataatctacgcctgcgctctgacaaactctacctttactacacccagctcggtaaatgcatgtactgcggcaagccaatcgagataggccacgttttcgatacctccaactacgacatcgatcatatctacccgcaatccaaaatcaaggacgacagtatctcaaaccgtgtcctcgtatgttcctcatgcaacaaaaacaaagaggacaaataccccctgaaatccgagatccaaagcaaacaacggggcttctggaacttcctccaacgtaacaactttatctccctggaaaaactgaatcgattaacccgaacgacaccaattagcgacgacgaaactgcgaagttcattgcacgccaacttgtcgaaacacgccaggccaccaaggtcgccgcgaaagtactcgagaaaatgttccctgaaaccaagatcgtctactccaaagcagaaacagtcagcatgttccgaaacaaattcgacatcataaagtgccgagaaataaacgacttccaccacgcccacgacgcatacctgaacatcgtggtcggaaacgtctacaacaccaaattcacgaacaacccgtggaacttcattaaagaaaaacgcgacaaccctaaaatagcggacacctacaattattacaaagtattcgactatgacgtcaaacgaaacaacataacagcctgggaaaaagggaaaacaatcataaccgtgaaagacatgctcaaacgcaacactccaatctacacccgacaggccgcctgcaaaaagggaggcctcttcgaccaaacgataatgaaaaaggggctcggacaacaccccctcaaaaaggaaggcccgttcagcaacatctcaaaatacggtggctacaacaaagtatccgcagcatactacacattaatcgaatacgaagagaaaggtaacaagatccgtagcctcgagaccatcccgctatatctcgtcaaagacatccagaaggaccaggacgtcctaaaaagctacctcacggacctcctggggaagaaggagttcaaaatactcgtgcccaagataaagatcaatagtctactaaagatcaacggatttccctgccacatcacagggaagacaaacgactcctttctcctccgccccgctgtccaattctgttgctcgaacgacgaagtactgtacttcaagaaaatcatccgattctccgaaataagatcccagcgcgagaaaataggcaagacaatatcgccttacgaagacctttcgttcagatcctacatcaaagaaaacctctgcaaaaagaccaagaatgacgaaatcggcgaaaaggagttctacgacctcctacaaaagaagaacctcgaaatttatgacatgctactgactaaacacaaagacacgatatataagaagcgaccgaacagcgccaccattgacattctagtaaaaggaaaggaaaagtttaagagcctaatcatagaaaaccagttcgaagtgattctcgaaatcctgaaactcttttcggcgacacggaacgtctctgagctacagcacatcggcgggagcaaatacagcggagtggccaagatcggcaacaaaatcagtagcctcgacaattgcatcttaatataccaaagcatcaccggtatcttcgagaaacggatagacctccttaaagtgtga

SEQ ID NO: 6741 - RNA, 4188 nt, synthetic construct
  misc_feature 1..4188: note = Cas9 variant
  source 1..4188: mol_type = other RNA
atgaaaaaggaaataaaagactacttcctaggccttgacgtcggcacgggctcagtcggttgggccgtaacggatacggactacaaacttctgaaagcgaaccgtaaggatctatggggcatgcgatgcttcgaaacggccgaaaccgcagaggtcagacgcctgcaccgcggggcccggcggcgaattgagcggcgcaagaaacgcatcaagctgctacaagagcttttctcacaggaaattgcaaaaatagacgaaggcttcttccagcgtatgaaagaaagcccgttctacgcggaggacaaaacaatactccaggagaacaccctcttcaacgacaaagacttcacggacaagacgtaccacaaagcctacccgacgatcaatcacctcataaaagcctggatagaaaataaggtcaagcccgacccccgactcctctacctcgcctgccacaatatcatcaagaaacgcggacacttcctcttcgaaggggacttcgactcagagaaccaattcgacacttcgatccaggctttatttgagtatctgcgggaagacatggaagtcgacatcgacgctgacagccaaaaagtaaaagagatactcaaagactcctccctgaaaaacagcgaaaaacaatcccgtcttaacaaaatactaggcttaaagccaagcgacaaacagaaaaaggccatcacgaacctaataagcggcaataaaataaacttcgcagacctatacgacaaccccgacctcaaggacgccgagaagaactcaatctcgttctcaaaagacgacttcgatgcactctcggacgacctagcctcaatcctcggagactccttcgaactcctcctaaaagccaaagcagtttacaattgttccgtcctaagcaaagttataggcgacgaacaatatctgagcttcgctaaagtgaaaatctatgaaaaacataaaaccgacctcaccaaactcaaaaacgtaatcaaaaagcacttccccaaagactacaaaaaggtattcggctacaacaaaaacgaaaagaacaacaacaactacagtggctacgtcggtgtatgcaaaaccaagtccaagaagctcattataaacaactctgtgaaccaagaagacttctacaaattcttaaagaccatactatctgccaaatccgaaatcaaagaagttaacgatatcctcactgaaatcgagacggggacctttctcccaaagcaaatctcaaagtcaaacgccgaaatcccctaccaactgcgaaaaatggaactcgagaaaatactctcgaacgccgaaaaacacttctcattcctgaaacaaaaggacgaaaaaggcctttcgcactccgagaagatcataatgctcctaacattcaagatcccgtactacatcggccccataaacgacaaccacaagaaatcttttcccgaccgttgctgggtgatcaagaaagaaaaatctcccagcggcaaaaccaccccatggaacttcttcgaccacatcgacaaagacaaaacagccgaggcattcataacatcgcgaaccaacttctgcacctacctcgtcggagaatcagtactaccaaagtccagccttctatactcagaatataccgtactaaatgaaatcaacaacctacagatcatcatagacggcaaaaacatctgcgacatcaaacttaaacagaaaatctatgaagaactcttcaagaaatacaagaaaataacgcaaaaacagatctcgaccttcataaaacacgaaggcatctgcaacaaaacagacgaggtcatcatactggggatcgacaaagaatgcacctcttcgctaaaatcctacatagagctgaaaaacatcttcggaaaacaagtcgacgaaatctcgactaagaacatgttagaagaaatcattcgctgggccaccatatacgacgaaggcgaaggcaaaacgatcctcaagaccaaaataaaggcagagtacggtaagtactgcagcgacgagcaaatcaagaaaatcctgaacctaaagttcagcggctggggcagactgtcccgcaagttcctcgaaaccgtaaccagcgagatgcccggattctcggaaccggtaaacattattaccgccatgcgagagacacagaataacctaatggaattactaagcagcgagttcaaattcaccgaaaacatcaagaaaataaacagcggctttgaagatgcagaaaaacagttctcatacaatggtctcgtcaaacccctctttctctccccctccgtcaagaaaatgctgtggcaaaccttaaaactcgtcaaagaaatatctcacatcacgcaggctccgccgaagaaaatcttcatcgaaatggcgaaaggcgccgaactcgaaccagctcgaaccaaaactcggcttaaaatacttcaagacctgtacaacaactgcaaaaacgacgcggacgccttcagtagcgaaataaaggacctctctggaaaaatcgagaatgaagacaacctaagactacgatcagacaaactatacctgtactacacacagctcggcaaatgcatgtactgtggcaaacctatcgaaatcggtcacgtgttcgacaccagcaactacgacatcgaccacatctatccacagagtaagatcaaggacgattccatctccaaccgagtcctggtctgcagcagctgcaacaaaaacaaggaagacaaataccccttaaagagcgaaatccaaagcaagcagcgcggcttctggaacttcctgcaacgcaataacttcatatctctcgaaaaactcaaccgactcacccgaaccaccccaatatcggacgacgaaacggccaaattcatcgcgcggcagctcgtcgaaacacgccaggctacaaaagtagccgctaaagttctcgagaaaatgttcccagaaactaaaatcgtctactcgaaggcagagacagtctccatgttccgcaacaaattcgacataatcaagtgtcgcgagatcaacgacttccatcacgcgcacgacgcctacctcaacattgtagttgggaacgtatacaacaccaagttcacgaacaacccctggaactttatcaaggaaaaacgggacaacccgaagattgccgacacgtataactactacaaagtcttcgattacgacgtcaagcgaaacaacatcaccgcgtgggagaaaggtaaaacaatcatcaccgtcaaggatatgctaaagcgcaacaccccgatttacacccgtcaagccgcgtgcaaaaagggcggactgttcgatcagaccattatgaagaaaggtcttggccaacaccccttgaagaaagaaggcgcattctccaatataagcaaatacggaggttacaacaaggtgtcagcggcgtactacactttaattgaatacgaggaaaaaggcaacaaaatccgctcgctagagacgataccgctttacctagtcaaggacatacaaaaagatcaagacgtcttaaaatcctacctcacggacctcctcggaaagaaagagataaagatactcgtgccaaagattaaaatcaattctcttttgaaaatcaacgggttcccatgccacatcacgggcaaaaccggcgactccttcgtcctgcgccccgcggtccagttttgctgcagcaatgacgaagtgctttacttcaaaaagatcatccggttcaacgaaatcagaagtcaacgagagaaaatgggaaaaacgatctctccctacgaagacctttcattccgaagctacatcaaagaaaacctatgtaagaaaaccaaagccgatgaaattggcgaaaaagagttctacgacttacttcaaaagaaaaacctcgaaatttacgacatgctgctcaccaagcacaaggacacaatatacaacaaaagacccaactccacaactctgggcatgctcaccaaagggagatacgagttcatcaacttgaaaccgaaagaccaaattatcgtaatgctcgaaatcctcaaactcttctgcaccacccgagaagccatcgatctcggcctaatcaagggtaagccggcagccggggtcgccacccttggaaagaaaatatcgaacccggacaactgcatcctaatataccagtccataacaggaatcttcgaaaagcgaatagacctgctcaaggtctga

SEQ ID NO: 6742 - RNA, 4188 nt, synthetic construct
  misc_feature 1..4188: note = Cas9 variant
  source 1..4188: mol_type = other RNA
atgggcgacaccgtgaaaaattatcacatcgggctagatatcggaaccagcagcgtgggcttcgccgctagagatgacgacaacaacctcatacgagtcaaagggaaaaacgtaatcggcacgcgcctgttctccgaaggacagaccgcccaggaacgccgcatggcgcgcgcgtcaaggcgccgctacaaccgtcgaaaatggcgtctacggctactagacgaaatcttccacgacgagatcatacacaaggacgccgagttcttcaataggctgaaacagagcagtctgagccccaaagacgagcgcaaacaatacttcggaagcctcctcttccccgaagtaggcgactccgagtattaccacgacggcaaccagacaatataccacttacgacacagactcatgacccaagacgaaaaagcggatattcgcgaaatctacttggcactccgccacataatcaaataccgcggaaactttctggacgacacgcccgtcagctcgttcgaggcgtccgacctcaaattggcgtccttcgtgcccacgctcaacgatctcttcgaaaccatcgacgtaaactacgagttcagtatggacaatattaacgagatagaagatatactactcaacaacaaactgagaaactccgacaagagcaagcagctacccgacctcctcacggaaccaattgtgaacatcgacgataaatcacttgagaagcagttcaacaaggaacggaccgacatcagcaaggagatcgccaagtcggtagtgggcagcaagatgaacgtcaacaagctcctcagcttcgaaagcagcgggggatacaagatcgcgttctccttctcggacgcctccagcgaagacaagatgatggagctgtcggacgtcctcgacgacagcagaatgaacatcctcaacatcttaaaagtcatatatagccgcgttcgcctcaaccaaataataccctccggtatgggcctcagcgaatcaatggtcgctgcctacgacctacacaagcaacaattaaaggacctaaagaaactattgaacgtccttccgttcaacgaacgatacgccgtaaaaatcgcgtacgcggcatacattgggaacatagacaaacagaaattcacaaaatccgaggtcaaaacaatcgacaaattgaaagaaaagtcggcaataatgaacgtactagactttaagtcaggacacatcaccaatgaggaactctcaaacgtcatcaaagtggtaattgttgacaaatacctaaacgacgaaaacttcgagtaccacagcatcgtcgagaaaatcaaccaagacatatcgaacggctcctacctactgaaacaacgtaacaaccaaaacgggaacataccacaccagctccaccagatggaactcgaccaaatcatagaaaaccagtcaaagtattaccctttcctcggggaactaaaccccaactcgaacagaaaccacatcgccaaatacaaaattagcgaactcgtagccttccgcgtaccatactacgtcggcccacttataacacccgaagaacaggaaaagacgagcggcgccagctttgcgtggatgaaacgaaaagaggacggagcgatcacaccctggaatttcgaagaaaaagtagacaaagaagaaaccgccagtcgattcataaaacgcctcacagtcaaagacacatacctcctaaatgaagacgtgctcccagacaattcgctgctctacgaaaaattcaaagtcttgaacgaactaaacgtcgtcaaggccaataacaagagactgacagtcgaggaaaaacaaggcgccttcgacaacctctttaagaaaatgaaaacagtcacagctaaaaagctgaagaactatctcgtatcaaaccataatcatatcaactctgtcgaaataacgggcctcagcgacgtagacaagtttaacaacagcctcagcacctacatagacttcaaaaagatattcgacgataaaatcgacaaccctgacctacttgatgatttcgaagacatcatcgaatggtccacagtgttcgaggaccgaaaaatattcgaagaaaaagtacgaaaggacatcagctggataagcgagtcagagatcaaggctgtagtgtccaagcgatacagtggatggggccgcctctccaaaaagctactgaacggcatcaccaacaacgagggccggaacataatcgacgagctttgggaagaaagcgaaaccttcatggaggcagtcagcaaaccggaagtaaaagaacaaatcgacggaatcaactcggacttcattaaaaacacagatatagaaagcgtcctcgcggacgcatacacgagcccccaaaacaagaaagccatccgcgaaacccacaagctagttaaagacatccaaaaagccatgggaggccaagcccccgcatctatctccatagagttcacccggaatccccaggacaaaggccaacttactcgctcccgtcactccgaagtcagtcgaaaatacaaggagatatcaaaggaagtatcgaagaccctaaacgacgagctcaaatccaagaaaaatagcatggacgtagacaaatactacctctacttcatgcaaatgggcatagacctttatgacggatcctcaatagatatagatgacctaaacaattaccaaatcgaccacatcataccacaatccttttacaaagacgacagcttcgataaccgtgtattaacacactattcgaacaaccagaagaaaggcaacaacacaccactcaatggactaaacatagatgacaaaacaagagcaatctggaaccacctccgcgacctcgggctcatcacaaagaagaaatacaacggcctaacgctcaaaggcatggaccagctcagcaaatacaccaaacacggtttcatccgacgccaactcgtagaaacttcccaagtcatcaagctagtggcgaacatcctcagcgacgagttctccacagacgacacgaaaataatcgaagtaaaagcaaagatgaactcacaaatccggcaagtcttcaatctctacaaagtccgagaactgaacgattatcaccacgcagtagacgcctacctgaccacttttatcggtgggtacctgtacaaccgctatcccaacctgcgcaacatgttcgtgtacggcgactttaagaaattctcagccgacgtggacaaccttaagactttcaacttcctacacgacattacaaacccctcagacaagttcgaagaccgcatcttcgatgagaaaagcggagaattaatcctcgacaggaagcacgcaatcgagaccatcaagaaaatataccaatacaaatatatgctgataacacgcgaggtgagtaccaaaaatggccaactgtcagaccaaacagtatacagcgcaaaacgaatcaacaacgtcaaagcaccaatccccgtcaagaaagactcgaatcccgaactctatgggttccggacagggaacgtagatcaccacatggtcatcgtcaaatatccgaagaaagacagttacgattacaaagtcgtgggcatcccactacgattcgtccagaaacttaaagagacaaaggacaataaagactatgaaaaccttcttaaccaaatcgtccaaatgaaactcaaccggaagaaacaggactttatcgtagtcgtcgacaacgtcatgtacggacagctcatccaggacggaggggaaaaatacacactcggtagcagcacgtacaaatacaatgccaagcagctagtcataaatatggataaaacgcgcattctggaagacaacagatacctcaactccttagacgaaggtgaagtctccgaaaaactggtcaatatatacaacgacataatgaaggtggtaaactcacgcttcgatctattcgacataaacaaattccgggaaaaactaaatgacggactcaataaattcaaaaacatctccaacgagcagaaagaagagaccctcctgaagatactgtccggtctgcactgcggcagcgcgaacgtccccataaaagagcttggcttaacaacgcccctaggaaaactacagctaccatcagggatagtcctatccgaagaagccgtggttatctaccagtcaccgtccggactattcgagaacaaagtcaggctcaaggacctatga

SEQ ID NO: 6743 - RNA, 4188 nt, synthetic construct
  misc_feature 1..4188: note = Cas9 variant
  source 1..4188: mol_type = other RNA
atgaagaaagaaatcaaagattacttcctcgggcttgacgtagggaccggatccgtcggatgggcggtcacggacactgactacaaactactaaaagccaaccggaaagacctgtgggggatgcgatgttttgagaccgctgaaaccgccgaagtacgccgactccaccgaggagccagacgccgaatcgaacggcggaaaaagagaataaaactcctccaagaactcttctcccaagaaatcgccaaaacagacgagggtttcttccagagaatgaaagagtcacccttttatgccgaagacaaaaccattctacaggaaaacaccctgttcaatgacaaggacttcgcagacaaaacctaccacaaagcatacccgaccataaaccacctcatcaaggcgtggatagaaaacaaagtcaaaccagacccccgcctcctctacttggcctgccacaacatcataaagaaacgagggcacttcctattcgaaggggacttcgactcggagaatcagttcgacacctcaatccaggccctcttcgaatacctccgcgaggacatggaagtcgacatcgatgccgatagccagaaagttaaagagatcctcaaagactcgagccttaaaaactccgaaaagcagagtcggctaaacaaaatcctaggcctcaagccctccgacaagcaaaagaaagccatcaccaacctgatctctggcaacaaaataaacttcgcagacctatacgataatcccgacctcaaagacgcagagaaaaacagcatctccttctccaaagatgacttcgatgccctctccgacgacctcgcaagcatcctaggcgactccttcgaactcctgctcaaagccaaggccgtatacaactgcagcgtgctctctaaggtcatcggcgacgaacaatacctatcttttgcgaaagtaaaaatctacgaaaagcacaaaaccgacctgaccaaactcaagaacgtcatcaagaagcacttccccaaagactacaagaaagtcttcggctataacaaaaacgagaaaaacaacaataactacagtggatacgtaggagtctgcaaaaccaaaagcaagaaattaataataaacaactcggttaaccaggaagatttctataaattcctcaagaccatcctctcggccaaatccgaaatcaaggaagtcaacgacatcctaacagaaatcgagaccggaacgttcctgccaaaacagatctcgaagtcaaacgccgaaatcccgtaccagcttcgcaagatggaactcgagaaaatactcagcaacgcggaaaaacacttcagcttcttgaagcaaaaagacgagaagggactctcacactccgaaaagatcatcatgctcctgacgttcaagatcccgtactacataggccccatcaacgacaaccataagaagttctttcctgaccggtgctgggtggtgaaaaaggaaaaatcaccatctggaaaaaccacaccttggaacttcttcgaccacatagataaagaaaagaccgcagaagccttcataacttccagaacgaacttctgcacctacctagtcggcgagtccgtcctccccaaatcctccctcctctacagcgagtacaccgtcctcaatgagattaataacctccagataataatcgacgggaagaacatctgcgacatcaagctaaaacaaaagatatacgaagacctattcaagaaatacaagaaaataacgcagaaacaaatctcaaccttcattaaacacgaggggatatgtaataaaaccgacgaggtcataattctaggaatagacaaagaatgcacttcaagcctaaagtcatacatagaactcaagaacatcttcggcaagcaagtggacgagatctctaccaagaacatgctcgaagaaataattcgctgggccaccatctacgacgagggggaaggaaaaacgattctaaagaccaaaattaaggccgagtatggaaaatattgcagcgacgagcaaatcaagaaaatactcaacctgaaattctctgggtggggacgactatcccgcaaattcctcgaaacagtaacctcggagatgccgggcttctctgaaccggtaaacataatcaccgcaatgcgcgaaactcaaaacaaccttatggaactcctcagcagcgagttcaccttcacagaaaacattaagaaaataaacagcggattcgaagacgcagaaaaacaattcagctacgacggtctagtcaaacccctcttcctaagcccttcagtcaagaaaatgctctggcaaaccctgaaactcgtaaaggaaatcagccacatcacccaagcacccccgaagaaaatttttattgaaatggccaaaggagccgaactagaacccgcacgaacaaaaacgcgtctcaaaatcctgcaggacctatacaataactgtaaaaacgacgcagatgctttctccagcgaaatcaaagatcttagtggcaaaatcgaaaacgaagacaacctccgcctgcgatcagacaagctatacctatactatacccagctgggaaaatgcatgtactgcggcaaaccaattgaaatagggcacgtcttcgacacctcgaactatgacatcgaccacatatacccccaatcaaaaataaaagacgacagtatttctaatcgagtcctagtctgctcgtcatgcaacaaaaacaaagaggacaagtatcccctcaagtcagagatacagtccaaacagcgcggcttctggaacttcctgcagcgcaacaacttcatctcacttgaaaaactgaaccgattaacccgggccacgccgatcagcgacgatgaaacagcgaagttcatcgcacgacaacttgttgaaacccgccaagcgaccaaagtggccgcgaaagtactcgagaagatgtttcccgaaaccaaaatcgtctactctaaggccgaaacagtaagtatgtttcgcaacaaattcgacatagtcaagtgccgcgaaattaacgactttcaccacgcccacgacgcatatttgaacatcgtcgtaggtaacgtctacaataccaaatttacgaacaatccctggaacttcattaaagagaagcgcgataatccaaaaatcgcagacacgtacaattactacaaagtgttcgactatgacgtgaagaggaacaacataaccgcctgggagaaaggcaaaaccattatcaccgtaaaggacatgctaaagaggaacacgcccatttacactcgccaagccgcgtgcaagaaaggcgaactcttcaaccagacgataatgaagaaaggactaggacaacatccgctcaagaaagaaggcccattctccaacatcagcaaatacggcggatacaacaaagtgtcagcagcgtattacaccctgatagaatatgaagaaaaaggcaacaaaatacggagcctggagacaatacccctctacctagtgaaagacatccaaaaagaccaggatgtcctcaaatcttatctgacggacctgctcggcaaaaaggagttcaaaatacttgtccctaaaatcaaaataaattccctccttaagataaacggctttccctgtcacatcaccggaaagaccaacgacagcttcctactgcggcctgcagtccaattctgctgctcgaataacgaagtgctatacttcaagaaaatcatcagattctcagaaatacggtcccagcgcgagaaaatcggaaaaaccatctccccatacgaagacctctcattccgtagctacatcaaggagaacctatggaaaaagactaaaaacgacgaaatcggtgagaaagagttctacgacctcctccaaaagaaaaacctagagatttacgacatgttgctaaccaaacacaaagacacaatctacaaaaagcggccgaatagcgccacaatcgacatcctagtaaagggcaaggaaaagttcaagagcctgatcatcgaaaaccagttcgaagtgatcctggagatcctaaaactattcagcgccacccggaacgtttccgacctacaacacataggtggttcaaaatactcaggagtagcaaaaatcggaaacaaaatctcctccctagacaactgcatcctcatctatcaaagtataacaggcatcttcgagaagaggatcgaccttctcaaggtctga

SEQ ID NO: 6744 - RNA, 4188 nt, synthetic construct
  misc_feature 1..4188: note = Cas9 variant
  source 1..4188: mol_type = other RNA
atgaacgccaaccgagaaatggcgtactacatcggtatagatatgggcaccggttccgtcggaatggctataacggacgagaattataacctgctcaaagtaaaaggtcaagactactggtttgtacgagagttcgagaccgcaaacacgcagataaaacgccgaatgcatagaatatcaaaaaggcgactcaggcgccaccaagtacgcgtggccctcatacgaagctactttgcggaagaaatcctcaaaaacgacccgctctttttcatacgccaagacaacagcatctattacctggaggacaaggactccgtattgaaaactaaggactgcctgtttgctgactataactaccacgacaagaattattataaagactaccccacgatattccacctccggcaagccttcataaaagacacagtaaaagacgacgagaatcacacgagatacgcgcgactattatacctcgctatcataaacatgtttgaacaccggggccactttctcctaaacagtgttagcgaagacataaacaaagaaatggttaaggacgcaggagaaggcttcaccctctacctccaagagcgaattaaagaaatcaaaccggtaagctattcggacatattggacgtcctagtagaaaagaatataagccgcagcgagaaaaaggaacgcatcgtcgaactattcgggatcaagaaatcgtgcaagaacggaatggaaatcataaagtgtctctgcgggctagaagcaaacgtagccataatgttcaacttggacgacatagagaataagctcacaatagtcgtctcaaaggacgactacgaagacaagctagcagaagtacaaccactcgtagacgaagagagcttcgaactcttatcgagaattaaacaactatacgactactctcagctacaaagcatcctaaaggggtacaaggagaaagaggacggcgaagacaagtaccttagcgacgtccgcgtcgagctgtacgaaaaacacaaagcggacctaaaactcctgaaaaaggtctacaaaagggacctcgacaagaaagggaaaatttgcgaagggaaaaacatacagcgaagctccaagtataacttcatgttccgctccggtaaagacggaacgtactccgcgtacaccaacagcttgaactccttctgctccaagaccatagaaaataaatacagacggaacatgaagaaccgcgaccgagcaagcctgtacgacacaatcaagaaggacttatcagggatagagaacgacgacgtgaagaaaatactccgtgacatagagactgaaaaattcctgccgaaacagatcacgggagaaaacggcgtcatacccaaccagatccatgccaaagaactaaaggcaatcctcaagaacgcagaaaaacaccttccatttctcaccgaaaaggacgactccggcctaacggtatccgagcgcataatatcgctattccgatactgcataccgtattacatcggaccggtcggcaaagactcccgcaccggatgggcgagcataaaggaggagggccagatctttccgtggaacatagaacaaaagatagacgtagacaaaacgagcgaagagttcattacacgcttgatcaaaacctgcacctatctaagcaacgaaaaggtcgtacccaaacaaagcctagtctacgaacgctactgcgtcctcaacgaaatcaacaatatcaagatccgcggaaagaggatcgacccccagctgaagcaagaaatcttcaaagagctgtacatcggttcaaaatgcgggaaaaaggtaacccgtaaaaacctgtgccaatacctcgtcaataaaggtgccatcgaggaagacagtgaaatatcaggaattgataaggatctcaacacatacatgagcagctacggcaagatgtaccagatcttcggggacaaaatcaaacgcgacgacatcaaagaagttgcagaagagataatctactacggcaccatatatggtggcgctaaggaaatgttcaaaaagaaaatagaacagtacgtgagcgaggacattctggacgaagcccaaatgaaccgtatattgggatttaaattcaaagactgggcccgcctcagcaagaaatttctgtacctcgaaggctacgacaaaggcaaccaaaatcaacttaccacgctaatgcaagcactctgggactacaacctcaataccatggaactcatgaatagcccgatgttcaccttcaaagagaccctcgagaagcagaaaaacaaaatggaaaaagtcctatgcgacttcgaatacgaagacctagatgagtactacttctccgcgcccgttaagcgtatggtatggcaaaccatagcgtgcctgaaagaagtggtccaaatcatgggccataaccccaagagaatattcattgaaatgccccgcgccgacgaagagaagggggagcaaggcaggaaagcgagccgcaaaaatcgcctactaagcctatacgaggagatcgaagacgaacgaccatggaagaaggagatagagaacgcagccgaatccggacgcctcaactcgaaacgaatgtatctctactacctgcaaatgggaaaggacgcctacactggagaggacatcgacatagaagacctctttgacaactccaaatacgacatcgaccacatctacccccgttccctcacggacgacaacagcctcgaaaacaacttagtcctcgtgtccgcgaccatcaatcaggacgtgaagaaaaacgactaccccatcccctacgacaaaatccgagggaactcaaaagtccgagagctgtggcgattcctccacgagaagaaatttatgaacgacgaaaaatacaacagactaatgtcagacgtccccctcacccaagaacagctggcaggctacatcgctagacaattagtcgagacggctcaggggaccaaaggcatcgccgacataattaaatccgtcatacctgacgccgacataatatactcaaaagccaaaaatgtctctgacttccgcaaacggtacggcatgctgaaaagtcgcctaaccaacgactttcaccacgccaaagacgcttacctaaacgtcgtagtaggcaacgtctacttcaccaaattcacacaaaacccacgcaaatacattaaggatgaaaacgacatcgagaataagaagtacaactacaaccttagcaagatgtacgacaaagacgtaatacgaaacggcaaggtggcctggatagcacagaacggtaagaaagccgggacaatccagacgatcaaaaaggtgatggaccgcaacacccccataatcacccgccaagcgttcgagcaaaggggcgagctctacgacctgcaacccataagtaaacacaaagccaagaaagaaaactatgtaccaatcaaggcaacaaacgagaaaatgaaagacgtcacaaagtacggaggattcacctccctgaacccggcctacttcgtattcgtggaatacggctccgcgaagaagagacaacggtgcttcgcagtcgttcacagctattgggcgtcctccatcaaaaacaacgaggacctcgtaacccacctcaaggaccgtggctacgaaaaccccatagtcatcgctgacaaaataaagaaaaactccctcattaagtacaacgggtatttcctctacattgttggcatggacgctcgaaagcaggtcgagttctcaaacgcgacatctatgtgcctcaacaacaatttcatccagtacatacagaagatcgaaaaagcgaacacgctgattgccgaagccaagaaacgccgcccgtatatagacgaaagcataacagcagaacgcaacatcgcgttgtacaacgaattgaaaaagaaacacctagacagcatcttcaaaaatcacccgaaaggtatcggcagtgtcctagagagtggagagggagcattcgtgcaactaagcctggagcaacagataggcatactatactccatcatccaatttagctcgttcaagaaaggcacttttagtctcacactcataggcggacctaaagaagtaggccggatcagaatctccggcaacatgcccaaagcccgcgaactgaaactaattcactactccataacgggaatgtacaagaaagaaatcaacctcctcgattga

SEQ ID NO: 6745 - RNA, 4188 nt, synthetic construct
  misc_feature 1..4188: note = Cas9 variant
  source 1..4188: mol_type = other RNA
atggaaacccaggcctcgaaccaacttatatccagccacctgaaaggctacccaatcaaagactacttcgtgggactcgacattggtacttcctcagttggatgggccgtcacgaacaaagcctacgaactgctaaaattccgcagccacaagatgtggggctcaaggctgttcgacgaaggtgagagcgcggtcgcgcgccgtggcttccgcagcatgcggcgccgtctcgagcgacgtaaactgcggctgaaactgctggaggaactgtttgccgacgcgatggctcaagttgaccccaccttcttcatgcgcctgcgtgagtccaagtaccactacgaggacaaaaccaccggccactcctcaaaacacatcctattcatcgataaaaattacacggaccaggactactacaaggaatatcccactatataccacctccgtgtggcccttatgaagtcagggacagacgacatccgcaaacttttcctagccgttcaccacatactgaaataccgaggaaatttcctgtatgaaggagccaccttcgactccaacgccagcaccctagacgacgttctgaagcaggccttggagaatatcactttcaactgtttcgacagcagcgcagccataggctcgatcggacagatactcatggaactaggcaagacaaagagcgacaaggccaaagcaatagaacgcctagtcgacacctacatcatcactgacgaagttgacacttcaggtaagacacaaaaggagcaggtcaaggaggacaaaaagcggctaaagtcgttcgccaatctggttctcggactgtccgcatcactaaccgacctattcggttccgtcgaggatcttgacgaggacctaaagaaattgcagataataggagacacctacgacgagaggcgcgacgatctagccaaagtatggggcgacgaaatccatattatagacgactgcaaatccgtatacgacgccataatactcatgtcaatcaaagaaccaggccttacgataagcgagagtaaagtgaaagcatttaagaagcataaggatgacctcgcgatccttaaatcactccttaagagtgaccggtccatatacaacaccatgttcaaggtcgacgaaaagggactacataactacgttcactatatcaagcagggtagaaccgaggagacgtcatgcaaccgtgaagacttttacaagtacacgaagaaagtcgtggagggactgcccgactcgaaagacaaggagtacatactatcagaaatagaactacaaacgctactgcccctgcaacggataaaagacaacggagtaataccctaccagctccacctcgaagaactaaaagtcatcctggctaaatgcgggcccaaattcccgttccttaatgaggtcgccgacggattctctgtggcagagaaactcataaaaatgcttgagtttaggataccatactacgtcgggccgctcaacacccaccacaacgtagacaacggtgggttcgcatgggcggtacgaaaagcgagcggccgagtgacgccgtggaacttcgatgacaagatcgatcgcgaaaagagtgccgcggccttcatcaaaaacctgactaacaaatgcacctacctgctaggcgaggacgtccttcccaaaagcagcctactctacagcgagttcatgctcctaaacgaactcaacaacgtacggatcgacggcaaaccccttgaaaaagcggtcaaggaacacctcatcgaagccgtattcaaacaagaccacaagaaaatgaccaaaaacagaattgaacaattcctcaaagataacaactacatcccagagaaacacaagcccgaaattacaggactcgacggggaaatcaagaacgacctcgcctcctaccgcgacatggttcggatactagggaacaatttcgacctctccatggcagaggaaataataacagacatcaccatctttggagagagcaagaagatgctccgagagacactccgcaacaaattctcctcgagactggatgacgaggccatcaaaaagctcagcaaacttcgatatagagactggggacggctttcacgaaaactcctcaacgtcatagaaggctgcgacaaagccggcgacgggacacccgaaaccataattatcctaatgcggaatttctcctacaatctaatggagctcctgggcgacaaattctcgttcatggaacgcatccaggagataaacgccaaactcatcgaaggccagatagtcaacccccacgacatcatagacgacctagccctttcaccagccgtaaaacgcgcggtgtggcaagcactccggatcgtggacgagatcgttcacatcaagaaaacgcttcccgcacgaatattcgttgaagtcactcgcagtaacaaagcagagaaaaagaaaaaggacagccgacagaaaagactttccgatctctatgccgcgatcaagaaagacgatgcgctcctgtcagggctgacgaacgaagagttcggcggactaaaaagcggactcgccaagtacgacgacgccgctctccggtccaagaaactatacctgtactacacccaaatgggacgctgcgcctacaccggagaagtcatcgacctctcgcagctcaacaccgacaactatgacatagatcacatatacccccgctccctcacgaaagacgactcctttgacaacctcgtcctctgcaaacgaaccgccaacgcccagaaatcagacacctacccgatctccaaagaaatccaaaaagctcaaaaagcgttctggatattcctcaagcagcaggggctcatcagtgaacggaagtacgaaagactgacccggatcacgccactaaccgcagacgatctttcgggatttatcgcccgccagctggtagaaaccaaccaatccgtcaaagccgcaactaccctccttcgccgtctgtaccctggcgtcgacgtcgtcttcgttaaagccgaaaacgtaactgacttccgacacgacaacgacttcataaaggtcaggagcctcaaccaccaccaccacgccaaagacgcctacctcaacatcgtggtaggcaacgtataccacgagcgctttacacgcaacttccgagccttcttcaaaaagaacggcgcaaaccgaacctataacctagcaaaaatgttcaactatgatgtcaaatgcacgaacgcaaaagatggcaaagcctgggccgtcaaaacttcgatggacacagtcaaaaagatgatggacagcaacgacgtacgtgtaacgaagcgcgtatacgaacaaaaagggcagctatcagatatcaacctaaccaaagcaagcaaagtaaaggccgacatctaccttcccataaaagccaacgaccccattatgtcacaaaacatgaaatacgggggatatagcgacatcaaaaacgcatactacaccatcatcgaatactccgacaagaaaaacaactccatcaaagcattcatccccatcccaatcttcatcgcgactaaaacactaaccaaacaagccctgttagagtatataaaaacagtcttgccaaaagccaacaacctacgcatcatatataagaaagtatacaacgatcagttacttaaaatcgacggctttaattactatctgggaggccgatccaacgaccgtttctgtattgacaacgctattcaacttatagtcccccttgaaatccagttctacattaagctagtggaaaaatttacagccatcatctcagagaacaaaaacatcgccctaaaagcctcatccgtaaaatcccgtaacccaataaacaaccaagtggaaaatatcaccctagagtatacacagaaactcttcgactacttagtctccaaattcaacgaactgatttacctcaaaatgaggggaaacaaactcaccgacgtaaacaatatcggtcgtaaacagttcataaaactgagcttagaggaacgctgcaaagcactagcagaactgctaaacatcttcacaaacatgaataagaaactatcactaagcactatcaatgtctccgcaagccgaaaagttgtcaactttaaaatctcctccctcgacgagtttaaaatagtgaacgaaagcattaccggactctacagccacgagatcaccatcgtctga

SEQ ID NO: 6746 - RNA, 4188 nt, synthetic construct
  misc_feature 1..4188: note = Cas9 variant
  source 1..4188: mol_type = other RNA
atgaatctaagaaatacgacagacgagtacaacatcggactagacatggggaccaatagcgtaggctgggcggtgacagataaagttggggcaatcgctcacttcaagggtatgcccacactcggctcgcgcctgttcgatgcggcccagacagcagcagaagctcgagcacatcgcggccaacgccgccggtacgtcaggcgccgctggcggctggatctcctgcaatccttgttccaagacgagatcgacaaggtagactcagagttcttcataagactcagacagagcaggctccacgtcgaagatcgcgaagacgggcacgcggactacaagtggcccatcttcaacgacagcgacttcacggaagtagactactacaaacgttttccaacgatctaccacctaagaaagtggctgatagaaacagaccagaaggctgacataaggctcatttacctagccgtccacaatatagtgaaacaccgaggcaattttctaagagaaaacaacaaaaacctttcttcgcgcaacgcagacccagccgaggcagtcggccaccttaggctagcccttaacaactggtgtctggagagagggtacgaatgcgcctggaagtcaggcggcaacgacaatgccatcctcaacgtgctcatcgacggagagaaacgtcgctcggatcaagtccgggaaatcgccaaactaacaggcatcgactgcggagacgcgaagcaatcaaggcaatgcaatgaagcaattgcaaaagccatagtaggactaaaggccgagatgaaaaatatcttcggcgagttcccagcggagaaaacgctgatctacctctcctccgacgacgacgtggaagtcgtacgagacgcctgcccagacgacagcgtcgaactgttccaggctctttgcgaactctacgccgcatacatcctacagggactactgtcctatgccccggggcaaacaatatcagttaacatggtaaagaaatatgatcggtacggagaggatctccacctcctaaaagaactcacccggacgtacgcatcaaagcgatatgacgcatttttccgaggcgaaacatacgaaggctctagcgactacgtagtagacaaggcccaagggtacacacgctacaacctaggcaccacacaactatcctacgacgactttcagaaagcggtcaaggagctattcaagggcacagacgcactacaggacgaacggtatcaaggaatgatggttgcgttcggcgagcaaaggttcctacgacgcctgaaaaccagcgacaacggatcaatatactaccagctacatttagaggaacttcacgccatcctggaaaaccagggcaaacattacccgttcctactcgcagaggaagacaaaatagagtcccttgttagcttccgcatcccatattacgtcggcccactcaccagagaaaacgcggccgtcggccacgacgggaaggaacgctttgcatggtccagcagacgggacggcatggaacacgcagtcatcaccccctggaactgggaggaaatcatcgaccgagacaagtccgccgaagactttatcatcaggatgacgggcgactgcacataccttcaaggcgaaccagtgctccccaaatgctcacttctatacgaggagttttgcgcactcaatgagctgaacggcgcacactggaccatcgacgaggacgacgagagacgcttcgacgctgcacaacgagaaagaatcatgtgcgacctattcagaagcacgcgcaaagtaacgtacaagaaagtatcagactggctcgaaagagaagattctttcgtcggggcgcgcgtccacggcgggcagggcgaacacggcttcgagagccagctcggaagctacatcttcttttgcaaggacgtattcaagaccgactcactggacgaagccgactacccaatgattgaacaaatcatactatggagcaccctattcgaggaccgcgacatcttaagacggaaaatagaagaggcgtacggcgacaggctgaccacagagcaaatcaaagtcatctgcaagaaacggtttgcaggctggggacgtctctcaaagaaacttttaacgggaataaaagttgacacggacacaggcagaaaaagcatcatagacgtcctccgagaagggaacccaaatgacgggcagcgtagtcggaccatggtgtttatggaagtcctgcgagacgaagggttaggcttccaaaaagccgtcgacgatttcaacagagactatttctcggaacacaacaacggcctcatggacgtgaacgacctgcccgggtcccccgcgatccgaagaagcataaaccaagcagtacggattgtagacgaaatcgtgtcgatcgccaagaaagaacccgcaaacatcttcatcgaggtaacacgggaagaggatgacccacgcaagaaaggcaaacgcacaaaaaggaggtacgacgccatcaaatccgccctagaggtcttcaagaaagacgacccacaactctggaaagagctaaccaagaaagactccaacaacatggacgaacggcttagcctatacttcatgcaacgaggaaaatgcatgtacagtggccgacccattaaaattgaagaactacatacgggaaaatacgaagttgaccacataataccccggagctacatcaaagacgactcactcgaaaacaaagtcttagtctaccgcgaagagaaccaacacaaaacagacacactcctaatagactcgtcgatccgcagaaagatgggcaaatattggcgaatgctccacaacgcaaagctaatcggcgacaaaaagtttcgaaatctattccgagaccacatcgacgacaaaacgatgaaaggcttcgtcgccaggcagatcgtagaaacgagccagatggtaaaactcgtccaaacgcttctcgaagcccgatacccaggcgcacgcatcgtacccgtaaaggcgaacatatcccacgacctaagagacgcagcaggactcgtaaagtgcagggaagccaacgacttccaccacgcccacgatgcattccttgcatgccgggtcggtctattcatccagaagagacacccaagcgtatacgacaacccgatcggcttggcccacataatgagagactacgcacgagcacaagcgagagaatacaagaaatcccactacttagcccacaccaaaggattcatcgtgaactcgttcctatcatctggctttgataaagaaacaggggaagttttcaaggacgactgggacgccgaagccgaggtggaaggtatccgacgggtgctaaactaccggcagtgcttcatctccagaatgcccgttgaagccacaggaacgttctgggaccaaacgatctactcaccaaaatgcggcaagaagctaacgctcccactaaagcgcggactagaccccgaccgatacggcagctacagcagagaacaattcgcatacttcttcatctacgaagcccgggacctaaagcacgaaagacatatactccaattcgcgcaggttccagtcagagtagctgcacacatcgccaaggatccatcccaactggagagctacgccgtaaaactggcgggacaggccaacctagccttcgtaagaatcgtgcgacggcgtatcctaaagaaacaattactcgaactaaacggagacaggctcataataacaggtgtacgagaggtacgaaacgccacagagttcgcattcagtctagacgaagaaacactaatagaacgctgcgtccagatagctaaagtaggtagcctcataggtgtagtaaacgacgaagacgaggaacagctttcagcggatctaaacgaactcttctcgtccctagttaaacgggggccgaaattatgcaatcgcctctacgcccagctcaagctcgacaaatacctatcaaagttcgacgaactgaccctcactgacaaggcaaaagttgtactccaactcatcgcgataacaaatggctcaataaacatggcagatctcagcgcactgggaagctcaaaatacgccggttgcatgcaggtcagctacttcaaacagctaaacgcgccaattggcgaggtgaacataatcgaccaaagcgtgaccggcatgtttgagcggagaacacatatcggcctgtga

SEQ ID NO: 6747 - RNA, 4188 nt, synthetic construct
  misc_feature 1..4188: note = Cas9 variant
  source 1..4188: mol_type = other RNA
atgaaagaaataaaggactatattataggcctggatatcggaacaaactcgtgcggttacgtggtgaccgacaaacaaaataacatcctcaaactgaagggcaagaccgcgataggggcccggctattcaaggagggacaagcggccgcagaccgacggtcctttcgcacaactagacgtcggctcgcacgaagacactggcgcctaggcctactcgaagaaatcttcgatcccgagatggaaaagatagacccgaacttcttcaggaggttaaaagaatcggattactcccccaaagattcgcggaaacaatttaacgcaatcgtctttaagtccattaaagccgacaagcgcttctacaagaagtaccccaccatctaccatctgcgcaacgccttaatgcacgacaatcaaaaacacgacctccgggagatattcatggcggtccaccacatcgtcaaataccgaggaaatttcctaagagaagactcagtcaacgcatttaaagccgcgaagttctcactccgaggcgaggacggcattggcccggtagataaactaaacgacctcctcaaggagatctatagcgagtactcccccgaactcgctactaacaacctaagcaaaatagaagacatcatcaaagacaagaacttgtacaaacaagataaacttaagcaagtcgcaactctcctcataaaagaagcagactctaaagacaaagcaaaactgaacaaagacatcgccaaacaagtcgccaattccttcatgggatacatgttccgactggacactctcttcagcctaacagacgtagacgtcaaagactacaaactcaaattctctgacgccaacatagacgaatctctagacgacctgacctcacttctcaccgacgctcaaatcgagttcgtcctagagctccaatccatatacaacacgatcgttcttaacgaaatcgtccccgacggaatgagccttagcgagagcatgattaagaaatacgacgaccacaaggaggaccttaaaatattcaaagagtatatagactccctctccgaccaaaagaaagccaagaaactcctctccgcatataacttatacgtgaactaccgcaaatccgacctcgtggaggctaagaacctattcaaaaacaagaaagtcggcgataaaaacttcgcagacgtcatctcgaattttgaagtcttcggaaaattcgtctccgacaacctggacgacagcgagctcgcgaacaagatcaaagcgagactcgacctcggggagttcctgcccaagcaacgaaccaaccagaacggcgtcatcccctaccaactccaccaagtcgagcttacgcaaatactggaaaaacaaggcaagtactacccgttcctaatcaccccaaaccctgttgaatcacaccggaacaacgcaccctacgaaatcagcgagctagtcagcttccgagtcccctactacgtaggtcctctaatagataaccaatccatcaaggacaagcaaaacaaaaacaaattcgcatggatggtccgacaaaaacaagggcagataaccccctggaacctcgaagaaatggtcgacacaacagaatccgcaaaccagttcatcaaaagaatgacacgcaaagacacatacctactagcggaagatgtcttgccaaagtcctcactcgtttaccaaaaattcatgatcctggacgaattaaaccgaattaaaatagacgggaaaaagctgacctccgagctgaaacacgacattttcgagaaacttttcaagaaacagaaatccattaacctcgacaacttaaagaattacctcctagtagaagggaacattccaggactcatcgaaggactttccgacggaatcaactttaacaactccttcagtacctacatcgactaccgaaacatcttcggagacgaaatcgacaacccaaacaaacaggcagactttgagaagatgatagaatggtccacagttttcgaggacaggaaaatcttcaaacgcaaacttaaggaaataacctggctcacaagcgaacaaataaagcaagtatcatccaaacgatactcaggctgggggcgcctcagcaagaagctcctcacccaaataacagacgagaacggcgtaaacatcctccagcgcctatggaacgaacccgagaccctaaccgaagtcttggccaacccagtcatcaagcgcaagatagtggaagctaacagcagtttcactaaagcaaaggacatgaaagatatcctcgtagaagcctataccagtccccaaaataaaaaggccattcgacaagtcatgagagtagttgatgacattatcgccgccgcccacggcaaaaagccatcccaaatcgcgatcgagttcgcccgtgaggaccaagacaacccccagatgaccaaatcccggaaggcgcagctggaccaaatttacgcgaaaatatctgacgagttcctagacgacgccgtaaagaatgaactcaaaaatatgaaggataacaaacctctagcgaaggacaaagtctttctatactttaagcaaatgggtcgcgacgcctactccggtgaaaaactaagccttgacaatctccaggactacgacatcgaccacatctacccccagagcttcataaaggacgactcattcgacaacagagtcctggtacaacgcgcgtacaataatggcaaatcagacaatgtgcccgtcctactgttcggcaacaaaatagcagcagggctcggcatcaccattagacagatgtggaagaaatggctcgaactcgggctcatatccaaacgcaaattcaataaccttatcaccgacccagagaaaataagccgaaacatggcttccggtttcgtaaaccgccagctagtagaaacctcgcaagtaatcaaactcgtcgccaacatcctgcaagcaaagttacccgatacagaaatcatcgaagtaaaagcatcctataacagtatattacgaaaagagttcaacttgtacaaaagccgcgaagtgaacgactaccaccacgccatcgatgcctacttaaccacaatagtcggaaactacctttaccaagtataccccaaacttagaccttacttcgtctacggccagttcaaaaagttcggcaaggcagaaaaccaagaagacgacccggtcaagaaaatcaagaaattcaacttcatctaccaattaatatggggaaaagacgacgcgatctgcatctcccacactaaccaacaagtattctcaaagaaagacatcatcgacaaactcacaacggcgtacaatttcaaatacatgaacatctcccacgcagtttacacacgcaacaataacatgttcaaacaaacccttttccccataatagaacgtacgaccgcgaaaacgaaatcactcatccccaagaaacttgacagacccacggacatatatggaggctacagcaacaataacgacgcttacctcgcactcgtcaaagtagacaaaaagcgcgggtccgaataccgggtcgtagggataccaatgcgcgcggcggccatgctcaaagcctcgaaaaactacgacgaggacctacggaaagtcatcgagccaatggtcatgttcgacaagaacggaaaggcgaaaaggggaatagaaggctttagagtcctagttggcaagatgccattcaaacaggccgtactggacgggaacaagaaattcatgctcaccggcacagtagacacccccaacctgaaacaactcgtcctatcacaacagaacatgaaatacatcctggactacatcgaggacgtcgattgtcgaaaacacaaattcggtgacaaggtccaaaatcccgataagtgcctccttgaagtcttcgatgaaatcattgaaatcgtagacaaatacttcgaactgtttgactcgcgtgacttcagagagaagctacggaactcacgaaacaaattcatcaaactcgaagcaagcaagaaagcggacaccatactggcaatactaaaaggactccaagccaaatccacccgagcgaccatcaaagagctaaacatctcagacttcgggcggatcattactagctccatctccccggaggcgcaactcatctaccaatcgccgacaggactattcgaacgtcgagtaaaagttaaagacctctga

SEQ ID NO: 6748 - RNA, 4188 nt, synthetic construct
  misc_feature 1..4188: note = Cas9 variant
  source 1..4188: mol_type = other RNA
atgtcaaagaaataccaaaacaccaaatactacgtagggctcgacatcggcacatcgtcggtcggttgggccgtcacggacgctaactacgaactcctcaaagtcaacggacacaagacgtggggtagccgcctcttcacggaagccgaaacagcactggaacggcggacccacagagcgacccgccgccgtcttcagcgacggaaacagcgcctagacctgttagacgaactattcgccgaagaactcgccaaggtggaccctcagttccttctacgcctaaaggagtcccaataccacatggaagacaaaagcactgatgataaatacgtcctcttcaacgaccaaaaccgtaccgatggcgaatttttcacagagtaccccacaatctatcacctccgatcagagttaatgcaagggaagaaggaagacatccgggccgtatacctcgcgctacaccacatcgtaaaataccgagggcacttcctcctacccggcgataactacgacatgcagggcaacctttccgagctgataaaacgcctctttaaattcatcgaagaaactcttttcatagaagacctaggtctgaccgacgagatccaaagcaaaatagaggaaatcctcctgaccaagactaaaacacgacttgacagacaaaaggaaatcgtcaagctattcaacactaaacaccagaagctagacgacaaacagaagaaactcctcgaagcaatcttcaaactatgtctgggactcaaaggcaacatggtgaacatattcggtgacaaaggcgaatacggaatcgacttcaccgacgtagaagacaaaaagaaaaaggtagagttcagcgcagattacgacaacaacatcaacgattacgtcgacttctttggggagtacttcgagctgctcgagatcaccaagaagatcaacgacacggtaatcttctcggaaatcctagtagacggcaaaggcttctccgaatccaaggtaattagctacgaaaaacaccaacaagacctccgaaaactaaaaacgcttctcaaaagcctggacaaaacacttggctacaagtacggcgaaggactctaccagaaaatacttctggatgacgtaaagtccaactatgtcaactactccggcaactcgcaaaagctcaagaaatgcactaaagacgagttctacggcttcataaaatcaaaactcaactccgtcaccaagaaagaaaaagtaagcgaggcccaacaaaaagaaatcgcccagatcctggcggacatggagttcggtgactatctccctctccagcgcacaaccgacaacggtgtcatccccaaccaactacacaagaaggaactaattgaaataatagagcagcagacgaagtaccacgacttcttcaacgacgtcgacgagaacggactcaccataaaggacaagataatcagcttgatgacgttccgcatcccgtactacgtcggaccactgaacgactaccacaaagtagccgacggcacagggcacgcctggattgagaaaaagaaagacggcaaaatatacccatggaacttcgacgagatggtagacaccgaagccacagccgaaaagttcataaagaatcttacaaacaagtgcacgtacctcaagggcgaagacgtgctcccgaaagaaagcaaactctattccgagttcatgctcctcaacgagctcaacaacattaaaatcgacaaccaaaaactcgaccccaagctcaagatgaagatggtctccgagcttttcatgaagaaaaacgagaaaatcaccaaaaagaaaatagtcgactacctccgctccataggacaggcaaacggaaacgaaatggtgtcgggcatcgaccgcgaaatcaaatcggacctcaaaacaatacataaaatacaacactattaccaagacgcaagcctggaaatggcggaaaacataattcgttggaacacgattttcaacgacagcacctcggatatactgaaagacaaaatcaccaaggcctacggcgacgtactaacaccaggccaaatcaaagggctcagcaacctcgcctgcaaggactggggaaaactttctgagaaatttctcacaggcataagatgtgacgtgggcgagttcaaaaacatctccatcatacaagccatgagagacaccaacaataacctcatggaactgctcagcaataagtacgagttcatggataaaatccaagaatacaacaaagaatactacggagactttacgttcaaggccgaaccatcgataatggatgacctttacgtcgggccaggcccaaagcgcgccatatggcaggccgtccgcatagtagaagaaataaaacgaataatgggccacgacccggaaaagatcttcctcgaaacaacccgcaccaaccgagcccccaaggtcaagaatactaaacgctacgacgcactcgaaaagaaatacgaatctgtcaaggaacacgaatacgcggaggtcaagaaagagttcgaaatagagaaaaacgactccctaaatatcaagaaactctttctatacttcacacaactggggcattgtatgtactccgatgagaaaatcccatacaacgaactgtttaccaatcgctatgacatcgaccacatctacccgcgttccaaaaccagggacaattcaatggacaatctagtactcgtcaaagccgaatgtaaccgcgacaaaaaggacaactatcccataaaactgaagacgaacatacagcagaaatgtcaagtccgatgggcgtacctcagggataagaaactaataaccgaagaaaagtacaatcggctagtacgcaagacccctttgaccgaagacgaactgtctcaatttattgcacgccagctggtgttcacatcccagtcagtaaaagccactgcagaggtattcaaacgcctctacgaggactcaaaaatttgttatgtaaaagcagagaacgtctccgatttccgctacggatccactcgcaaaatgtctaaagacgaccaaccccagccgtttatcaaaaatcgcgacgtaaacgacttccaccacgccaaggacgcctacctcaacatagtagtaggtaacgtttacgacgtgaaatttacccagaatcccacacggttcatcaaagctaataaagactattccctcaactatatattccgttaccctgttaacaagaaaggtgaaaacgtatgggacccagaacaatccatgaaaatagtagagaagacgctcaagagcaacgacgtcagagtcaccaaactggttaagccgataacctcgccaataagcaacgagacgttacacaaagccctcaaatgtaaacccggatcctacctgcctcgtaaaagcagcaaaggcacgccactcgcagacgtcaccaaatacggcggctacgagaaaataaagaacgcctactactccatctacaaatatacctatatgaaaaagaaagaatgcatggaggagttcttgctagtccccatacccatccacctagtcaataacgacgaagagttaccaaaatacattaacgacaagatagccgaaagggccaaaaagaagaaactcgaaactgtagagtgcatcgtcaaagaactttaccagggtactcttgtacgaataaacggctacgactaccgaatcgcaggcagtagcggaaaacaatttgaactccacaacggcatcaacctgatcgtagaaccctgggtagagaaagtgctgaaagaaaccgacaagttcgtcaggaaatccaactccaaactggacaaaaagcaacaaaaggaaaacaccacagaaaccctcatcgaaaaacaactcaatgacgtcttcgagtacttatgccgaaagctgaaccaagggatcttcaaaaataacaaacacaccctaccggccaaactgctcggcgatagcatacagaaaaggttcgaagacgccagcattgaggacgagtttgaagtgataaaggaactcatatccgctatcgccaaaaacccccaaaacttcaagacgatccaaaaagtcctggacatttcggggtcatcaatccccaggttcaacttgaagctaacgaaaaacaatgtcgacgagttcatcataaagaacgaaagcgtcacaggactgttcacacacgaaaaggtgatcttccgcaaatga

SEQ ID NO: 6749 - RNA, 4188 nt, synthetic construct
  misc_feature 1..4188: note = Cas9 variant
  source 1..4188: mol_type = other RNA
atgaagaaagaaatcaaggactacttcctaggcttagatgtaggtacaggatccgtcggctgggcggtaaccgacacggactacaaactcctcaaagcgaatagaaaagacctatgggggatgcgatgcttcgaaacagcggagaccgcagaggtccgtaggctacaccgtggggctcggcgaagaatagagcgcagaaagaaaaggataaagctgctccaggaactcttttcccaagagatcgccaaaatagacgaaggcttcttccagcgaatgaaggaaagccccctatacgcagaggataaaaccatcctccaagagaacacacttttcaacgacaaggacttcacggacaaaacctaccacaaggcctaccctaccatcaaccaccttataaaggcctggatcgaaaataaagtaaagcccgaccctcgtctattatatctcgcctgccataacatcatcaaaaagagaggtcacttcctgttcgaaggcgacttcgacagcgaaaaccaattcgacactagcatccaagcactttttgaatacctccgcgaagacatggagctagacatcgacgctgacagccagaaagtgaaagagatcctcaaggactcatccctcaaaaacagcgagaagcaaagccgacttaataaaatgctcggactaaagccaagtgacaaacaaaagaaagccatcaccaacctgatatcggggaacaaaataaacttcgccgacctctacgacaatccggacctgaaagatgccgagaaaaactcaatatcgttttcaaaagacgactttgacgccctcagcgacgacctagcgagcatactcggggactcttttgaactcctccttaaagccaaagcagtgtacaactgctccgtcctttcaaaagtgataggcgacgaacaatacctaagtttcgctaaagtcaaaatctatgagaaacacaagaccgatctgaccaagctcaaaaatgtcattaaaaagcacttcccaaaggactacaagaaagtcttcggctataataaaaacgagaaaaacaacaacaactatagcgcatatgtcggggtatgcaagataactcacaagaaactcgtaattaagaactccgccagccaagaagacttctacaagttcctaaagactatcctctccgcaaaatcagaaatcaaagaagtcaacgacatcctcacagaaatcgagaccgggaccttcctcccaaaacaaatctcgaaatccaacgcagagataccctaccaactgcgaaaaatggaactcgagaaaatcctaagcaacgcagaaaaacactttagtttccttaaacagaaagacgagaaaggtctctcacacagcgagaaaatcatcatgctactcacattcaagatcccctactacatcgggccaatcaacgacaaccacaaaaagagcttcccagaccgatgctgggtggtcaagaaagaaaagagcccaagcggaaaaactacaccgtggaacttcttcgatcacatcgacaaagagaaaaccgccgaagagttcatcacctcccgcaccaacttttgcacttatctgatcggcgaatccgtgttacccaaaagcagcctcctctactcagaatataccgtcctcaacgaaataaacaaccttcagatcatcattgacggaaagaacatatgcgacatcaagctcaagcaaaagatttacgaagaactattcaagaaatacaagaaaataacacaaaaacagatttcgacgttcattaaacatgaaggaatctgcaacaaaactgacgaagtcatcatcctgggaatagacaaagaatgtacatcatccctcaaatcctacatcgaactgaagaacatcttcggtaaacaagtagacgaaataagcaccaagaacatgctagaagagatcatccggtgggcaacaatctatgacgagggcgaggggaagaccatattaaagactaaaatcaaagccgaatacggcaaatactgctcagacgaacaaattaagaaaatactcaaccttaaattctctggctggggcaggctatcgcgaaaattcctagaaacagtcacgagtgagatgcccggattctcggaacccgtcaacatcatcactgccatgcgtgaaacccaaaacaacttgatggaacttctatcttccgagttcaaattcacggaaaacataaagaaaataaactcaggcttcgaagacgcagagaagcagttctcatataacggactggtcaaaccacttttcctcagcccaagcgtcaaaaagatgctctggcagacacttaagctagtcaaagagatcagccacatcacccaagcaccgccaaagaagatcttcatagaaatggcgaaaggagccgagctcgaaccagcccgaaccaaaacacgactaaagatactgcaagacctatactcaagttgcaagaacgacgcggatgccttctcgtccgaaatacaatacctctccggaaaaatcgagaacgaggacaatcttcgcttgcgcagcgacaagctatacctgtactacacacaactcggcaagtgcatgtactgcgggaagcccatcgaaataggccacgtattcgacacatccaactacgacattgaccacatatacccccaatcgaaaatcaaggacgattcaatctccaaccgagttctcgtatgcagcagctgcaacaagaacaaggaggacaaataccccctaaaagcagaaatccaatcaaagcaacggggcttctggaacttcctacaacggaacaacttcatcagcctcgagaaactaaaccgactcacccgcacctcccccatatccgatgacgaaacagccaagttcattgcgcgccagctggtcgagacccgccaggccacgaaagtggcagccaaagtcctcgagaaaatgttccctgaaacaaaaatcgtatattcaaaggcagaaacagtctccatgttcagaaacaaattcgatataataaaatgcagagaaatcaatgacttccaccacgcccacgatgcgtacctgaacatcgtagtcggcaacgtctacaacaccaaattcacaaacaacccatggaacttcataaaagaaaagagagacaaccccaagatcgccgacacctacaactactacaaagtcttcgactacgacgtcaaacgcaacaatataaccgcgtgggaaaaaggcaaaacaataatcaccgtcaaagacatgttaaaaagaaacacaccgatctacactcgacaagcggcatgcaaaaagggggaactattcaaccaaacaataatgaagaagggactaggccaacatccgctcaaaaaggagggcccgctgtcgaacatctcaaagtacggaggctataacaaggtgagcgctgcatattacacactgatagaatacgaagaaaaaggtagcaaaattcgctccctcgagaccataccactctacttagttaaagacatacagaaaaacaaggacggtctcaaatcttacctcaccgatcaaatcgggaaaaaggagatcaaaattctgatacctaaaatcaaaatcaactccctacttaaaataaacggtttcccatgccacataaccggaaaaatgggcgaggcattcgtccttcgaccggctgtccagttttgctgctcgaacgacgaagcgctatatttcaaaaagataattcggtttaacgagattcggaaacaacgagaaaagatgggaaaaacaatttccccatacgaggacctcagctttcgcagttacatcaaagacaatttatgtaaaaagaccaaggcagacgagatagaagaaaaagagttctacgacctcctgcagaaaaagaacctggagatctacgacatgctgctcaccaaacacaaggacaccatatacaagaaaagaccgaacagcgcaaccatagacatcctcgtcaaaggcaaggagaagttcaagtccctcatcatcgaaaaccaattcgaggtcattctagagatactaaaattattcagcgcgactagaaacgtaagcgacctccaacacatcggcgggtccaagaacgcagggaatgcccgggtggggaacaaaatctctagcttggacaactgcatcctgatctaccaatcaatcacgggcatatttgaaaaacgcatagacctgctcaaaatctga

SEQ ID NO: 6750 - RNA, 4188 nt, synthetic construct
  misc_feature 1..4188: note = Cas9 variant
  source 1..4188: mol_type = other RNA
atgtcattcaagaaaatcctcggactcgatgtcggagtagcatcaatcggctgggctgtggtacgagaaaacgaagaaaacccaaacttcaacacaataaccaaacttggggtccgcgtagtgcccataacatcggacgaaaaattaaacttcgaaaaagggaaaagcatcacttccaatgccgaacgcacactcgcaagatcttcccgtagaaatctccagaggttccgcctcagacgcaaaaacctcatcgctatcctcctgcaaaaccaaataatcacccccacaacacctctaaccgagaaagggaaattcacgacttttgaaacactaaaaatacgtgctaaagcaacgaaagaaaagatagaactagaagaactagctcgtgtgctcctccacatcaacaagaaacgcggctacaaaagctcacgaaaagtcaaaaacagcgaagacggaaaagccatcgacggcatggaagcggccaaaatcctatacgaaaacaaactaaccccaggtcaatacacctatcaattactcgaaaaaggctccaataaaatcccagacttctactgctcagacctccagatagaatgggaagttatatggaacttccaaaaacaattctatcccaacttactaaccgaagatttcaagaaagaactcaaaggcatcggccaaagggccaccgctgcactcttcctcaagaaatacggcatatacactgcgctaaacaaaggaaaacgagaagagaagaaactccaagcctacaaatggcgctccaaatccgtgtccgaaaagatcccggtggaggaactagcgtacgtcatagccgaaatcaattcccacatcacgaactcctccggctatctcggcacaatctccgaccgttccaaggaactgtatttcaaccaacagaccatcggcgaaaatctctacgcccaggtcgccaaaaacacccacgcgaaactaaagaaccaggtcttcctccgccaagactactccgccgagttcgagcaaatctgggaaacacaagccaaattccacccacagctaacacccgaactaaagaagaaaataagagattccataatattttaccaacgcaagctacgctctcagaagcgcctcattagcatctgcgagttcgaaaaccgcgaaatcgagatcattaaaaatggcaagaagaagaagaagaaaataggactaaaagcggcccctaaatcctccccactcttccaggagttcaaaatctggcaagtcctgaacaacatcgtaattaaacaagaaggcaaagaccggctcctaacgtgggaagaaaaagaattactctttacagagctaaacatcaaaggcaacatcagcggacaaaaggcgctcgccctcctgaaactgagtccgaaagatacaaagataaacgtaaccatcctcgaaggcaatcacacacaagaacaactataccgagtctacctgcgtatcctaggtatggagggctatgacgtcttcgacctcctaaagataccagaaaatcaagacgagatcaaaccggcagactcaaagataagcgctgccgaaataaaggaaacagtcaaatccgtcttcaaaacatgcagcataagcccctcaatcctggacttcgacccactgctccccaaccccgagttcgaaaatcaaagctcgtaccaactctggcatcttctttactcgtacgaaggtgacagtagccccagcggcaacgaaaagctgctcgaactactaaagaataaattcggattcaagaaagagcacgcgcttctgctagcatcaatttcatacacctacatatacggcaacctctccagcaaggccatgagaaaaatctacccctactctaaagaaaacacatactccgaagcatgcatgctggccggatacagacattccaaaaacgcccttcctcgggaagagttagtaaaataccaactaaaagaccgactagaaatccttccgaagaacagcctccgcaacccagtggtcgagaaggtgctcaaccaactcataaacctggtaaactccctaatggacgagtacggggcctttgacgaaatccgcctcgagatggccagggaacttaaaaagaacgcgaaggaaagagaaaagtggtcgaaaaacatcgccgacgccacatcccggaaccagaaacacgcggagattctaaagaaagatttcaaaatctccaaccccagcaaaaacgacctaatccgttataggctctacctggagcttaaggccaacggctacaacgacctctatacaaacacctacatagacataaattacctattcacacaccgctacgacatcgaccatattattccgcaaagcaaagtcttggacgactccttctcaaacaaagtactcgttccgaggcaagcgaacctcgagaaaagcaacctcaccgcattcgactacatctcacaccaaggaaaagagaaagaagaacactacctaaatgtaatcaccgagctctataagcgcggaagtatctccgaaaccaaatataaaaacttgcagaagaaaggcaacgagatcggagagggtttcatcaaccgggacctaaagaacacccaatacatcgtacgcaaagcgcgggaaatcctcagtttaataacacctaacgtagtgaccacaaccggcgagattacagcaaaactccgcaaagactggaaccttatcaactccatgaaggagctgaacatggataagttccgcaacgcacggcttaccgagttagtggaaaactcacgtggcgaaaagaaagagattataatcgactggaacaagcgtaacgatcaacgacaccacgccatcgacgcccttgttgtagcattcaccaccagaaaccacgtacaatacctcaattacatgaacgcgagggaggacgaaagccacaagcaacactcgcatattctatcaatagaaaagaaaatcaaatacgataaattccacgagaacggcagccgacagagccgcttcatctatccgacgagcaactttcgcgaagaggcaaagaagaaactaaaggaaatacttgtaagctacaagaccaagaataaagtcgtcaccgtcaacatcaacaagccgaagaaaaagggcggctacagtcctaaacacgagcttacaccccgcggccccttacacaaggagaccatctacggaatgattcgcatactacacaccaaagaaatcaaggtcagttcgaaactgaacttcgagacagtcgtcagaatccaaaacccacgataccgcaacgccttacttgaaaggctgaaagacaacttcaacgaccccaagaaagcattcagcgggaccaacagccttaccaagaacccagtatttctaaccgccaactcaaccgagacagtgcccgagaaagtcaccatccagtggttcgagaaggtctacacgatccgcaaacccatcaatcccactaacttcaaaaacgagaagaacatcgaaaaggtactagacccaacgatccgaacactcctgaaaaagcgcctacaagaatacaatggaaacgctaaagaggccttctcagacctcgagaaaaaccccatatggctcaatcaagaaaaagggatttgcatcaagacggtaactatcaccggtataagcaatgtggaaagcctccataccaagaaagaccactttgggaaagaactgcttgacatcaacggcaaccctatcccggtagacttcgtctcaaccggcaacaaccaccacgttgccatatacgaagattccgaaggaaacctacaagagaaagttgtctcattctacgaggccgtcgaaagggtcaaccaaggcctccccgtcatagataccctgtataacctggaccttggatggaaattcctcttcaccatgaaacagaatgaaatgttcctattccccgcggacgacttcgatccgaatgatatagacatctacgacgagaaaaacttaatcctgatatcaaagcacctcttccgagtacaaaaactctcgagcaaggactactgcttccgacatcaccttgagacctccattaatttcaacgaccctgcacttaaaggaataacatggcggagagaaagcccaaacggcttacgcaaccttgtaaaggtgcgtttaaatcatctgggcaaaattgtacacatcggcgaatga

SEQ ID NO: 6751 - RNA, 4188 nt, synthetic construct
  misc_feature 1..4188: note = Cas9 variant
  source 1..4188: mol_type = other RNA
atgaagaaagaaataaaggactacttcctcggcctcgacgtgggaaccggatccgtaggatgggcagtcacagatacggactacaagctgctcaaggccaaccacaaggacctctgggggatgagatgcttcgaaacggcggagaccgcggagaagcgccgcctcttccgaggtgcgagacgcagaatagaacgacgaagaaaaaggattaaactcctacaagaactgttctcacaagaaatagccaaaattgacgaagacttcttccagcgcatggaagagagccccttttacgccgaggacaagaccatcctacaggaaaacaccctcttcaatgaccgtgacttcacagataagacctaccacaaggcatacccaaccatcaaccatctcataaaagcatggatcgagaacaaagtcaagcctgatccgcgactcctctacctggcatgtcacaacataatcaaaaagaggggccacttcctattcgagggcgactttgactctgagaaccaattcgacacaagcgtacaagccctctttgaatacctccgggaagatatggagctcgacatagacgccgactcgaaaaagataaaagaaatcctaaaagactctgccctgaaaaactcagacaaacaaaaccgcctaaacaagctcctcgggctcaagtcatcggacaagcaaaagaaggcactcacaaacctaatatcaggcaacaaagcgaacttcgccgatctatacgataacccagacctgaaagacgcagagaagaactcaatctcattctctaaggacgacttcgacgcgctcagcgatgaactcgcgagcgtgctcggagacagcttcgaactgctcttacgtgcaaaggccgtctacaactgctcagtgctctccaaggtcatcggcgacgaacagtatctcagcttcgcgaaggtaaagatctatgaaaagcacaaaaacgacctaaccaaactcaaagaagtcgtcaaaaagtacttccccatcgagtaccgcaacatcttcggctacaaacaatcggagaacaacaactgtaactactcccggtatgtcggggtctgcaagagcggttccaagaagaaagttataaacaagaccgcatcgcaagaggacttttacaaattcctaaaagacatactgctaaagcgaagcgacgtcccggaagcgaacggaatcctaacagaaatcgagaccgggacctttctccccaagcagatatccaaaaataacgcggaaatcccataccaactgcgaaaaatcgagctagaaaagatactgacgaacgccgaaaagttcttcagcttcctcaaacaaaaagacgagaacggcctctcccactcagagaaaatcatcatgctactcaccttcaagatcccgtactacatcgggccaattaacacatcccacaaacagtatttcccagaccggtcctgggtcatcaagaaagaaaacgcaccccaagaaaagattactccgtggaactttttcgaccacatagacaaggaaaagaccgccgaagccttcataaccagccgaacgaacttctgcacttaccttataggcgaatcggtccttcccaaaaattccctcctatacagcgaatacaccgtcctaaacgagataaacaacctacaaatcatcatagacggaaagaatatatgtgacgtcaaactgaaacagaaaatatacgaagaactctttaaaaagtataagaaagtcacccaaaaacaaataagtacatttatcaagcacgagggcatctgcaacaagacagacgaagtgatcatactcggaatagataaagagtgcacctccagcctaaagagctacatagaactaaagaacatcttcggcaagcaagttgatgagatatcaaccaaaaatatgctagaagatatcatccgctgggcaaccatctatgacgaaggagagggaaaaaccatcctcaaaacaaaaatcaaagcagaatacgaaaaatactactccgatgaacagatcaagaaaatccttaacctgaaactttccggctggggaaggctaagtcgcaaattcctggaatcaataacatccgaaatcccaggcttcatcgagccagtgaacattataaccgccatgcgagagacacaaaacaacctcatggaactcctgtcaagcaaattcaaattcaatgaaaacatcaagaaaataaattctggtttcgaagacacagacaaacgattcagctacaacagcctcgtaaaaccactgttcctgagcccctccgttaagaaaatgctgtggcagacactgaagctcgttaaggaaatatcacatataacccaggccccacccaaaaagatattcatcgaaatggcaaaaggcgccgagctggaaccagcccgaaccaaaactaggctaaagatcctccaagatctctacaactcatgcaaaaacgacgcagacgcattcagctccgagatccaatacctcctcgggaaaatcgagaatgaagacaacctgcgcctgcgtagcgacaaactctacctatactacacacagctcggaaagtgtatgtactgcggaaagccaatcgaaatcggccatgtctttgatacaagcaaatatgacatagaccacatctacccccaaagcaagataaaagacgactccattaataaccgagttttagtatgctcctcatgcaacaaaaacaaggaggacaaatacccactaaaacctgaaattcaacttaaacagaagaaattttggaatttcctacaaaggaataatttcatatcaatagagaaattcaaccgactgactcggaccacacccatatcggacgacgagacagcaaaatttatcgctcgccagctagttgagacgcgccaagcaaccaaggttgccgccaaggtactggagaagatctttcccgaaacaaacatcgtctacagcaaggcggagaccgttagcatgttccgcaacaaattcgacataatcaagtgccgcgagatcaacgacttccaccacgcccacgacgcctacttgaacatagtcgtgggtaacgtctataacacgaaattcaccaataacccgtggaacttcataaaagagaaacgggacaatcctaaaatcggcgacacttacaattactacaaagtgttcgactacgacgtcaagcgaaacaacatcaccgcctgggaaaaagaaaagaccatcattaccgtaaaaaccatgctcaaacgcaacaccccaatatacacgcgacaagccgcgtgcaagaaaggagaactgttcaaccagacgataatgaagaagggcctcggccaacatccactaaagaaagaatgcccattctcaaacatctccaaatacggcggctacaacaaagtgtcagccgcatactacaccttcatagagtatgaggagaaaggtaacaaaatacgctcactggaaacgatccccctctacctcgaaaaagacatccaaaaatcccaagacgggctaaagggctatctcaccgaccagctcggcaaaaaggaaatcaagatactcgtacccaaaattaaaatcaactccctcttgaaaatcaacggattcccctgtcacataacaggaaagacaggagcgagcttcgtgctgcgccccgcggtccaattctgctgctcgaacgatgaggtactatacttcaagaagatcatccgattcaacgagattcgatcgcaacgtgagaaaatgggaaagacgatcagcccgtacgaagacttgagcttccggtcatacatcaaagaaaatctctgcaagaaaaccaaaaacgacgagattggagaaaaagagttctacggcttcctccagaagaaaaacctcgagatctacgatatgctactgatcaaacacaaagacacaatctatagtaaacgcccaaactcgacgacactagacatgttaatcaaaggcagatacgagttcataaacctaaagcccgaagaccaaatccgcgtaatgctggaaatcttgaaactgttctgcaccaccagagaggtaatcgacctcggcctaatcaaagggaaatctgaagctggcgtaacaacactaggcaagaagatctctaacctggacagctgcattcttatctaccagagcataactggaatctttgagaaacgaatcgacctgctaaaaatatga

SEQ ID NO: 6752 - RNA, 4188 nt, synthetic construct
  misc_feature 1..4188: note = Cas9 variant
  source 1..4188: mol_type = other RNA
atgaagaaagagatcaaagactacttccttgggttagacgtcggaaccggatccgtcggatgggcagtcacagacaccgactacaaacttcttaaggcgaaccggaaagacctatggggcatgagatgcttcgaaaccgccgagaccgccgaggtgaggaggctacaccgcggcgcccgacgacgaatagaacgaagaaagaaacgaatcaaactactccaagaactcttctcacaagaaatcgcgaaaaccgatgaaggctttttccaaaggatgaaagaaagccccttttacgcggaagacaaaaccatacttcaagagaatgcgctctttaacgaccgcgacttcaccgataaaacctaccacaaagcctaccccaccataaaccacttaataaaagcctggatagagaacaaagtgaagccggacccccgcctactgtaccttgcctgtcacaacataatcaagaaaagggggcatttcctcttcgagggcgatttcgactccgaaaaccagttcgatacgtctatacaggcattattcgaatacctgcgcgaagacatggaagtcgacatcgacgccgacagccagaaagtaaaggaaatactgaaagactcgagcctcaaaaatagcgagaaacaaagccgactgaacaaaatgctggggctgaaaccgtccgacaagcaaaagaaagcaataacgaacctcatcagcggcaataaaattaacttcgcagacctctacgataacccagacctaaaagatgctgagaaaaacagcatctcgttctcaaaggacgactttgacgctctgtccgacgacctagcttcgatactgggggactcattcgaactcctccttaaagcaaaagccgtttacaactgtagcgtactgtccaaagtcatcggagacgagcagtacctgagcttcgccaaagtgaaaatctacgagaagcacaagaccgacttaaccaaactgaaaaacgtaataaagaaacacttcccaaacgactacaagaaggtctttggctacaacaaaaacgagaaaaacaacaacaactactccgcctatgttggtgtatgcaagacaaaatcgaagaaactcgtcatcaacaatacagtcaaccaagaagacttctacaaattcttgaaacccatcctactcgcaaaatcggaaataaaagaagtgaacgacatactcaccgagatagaaaccggaaccttcctaccaaaacagatttccaaatccaacgccgagatcccatatcaattacgcaagatggaactggaaaagatactcagtaacgcagaaaaacacttcagcttcctaaagcagaaggacgagaagggcctcagccactccgaaaagattataatgctcctcacattcaaaattccctactacatagggccgataaacgacaaccacaagaaatctttcccagatcgctgctgggtaatcaaaaaggagaaaagcccgagcggcaagaccaccccatggaacttcttcgaccacatagacaaagacaagacagcagaagccttcataacatctcgaactaacttctgcacctacctagtgggggaatcggtactcccgaagaacagtctactgtacagcgagtataccgtactaaacgagatcaacaacctacaaatcatcatagatggtaaaaacatatgcgacataaaactcaaacaaaagatatacgaagaactcttcaagaaatacaagaaaatcacccaaaaacaaatctctaccttcatcaaacacgaaggtatatgcaataagacagacgaggtcataatcctcggcatcgacaaagaatgcaccagctccctcaaaagctacatagaacttaaaaacatatttggcaagcaagtagacgaaatctccacgaagaacatgctcgaagagatcatccgatgggcgaccatttatgacgaaggtgagggaaagacaatcctcaaaacgaagataaaagcggagtacggaaaatactgtagcgacgaacaaatcaagaagatcctaaacctcaagttctctggctggggccgcctctcccgtaagttcctagagaccgtcacgtcagagatgccaggtttttccgaacccgtcaacataatcaccgcgatgcgggaaacacaaaacaacctcatggagctgctatcatcagagttcaagtttaccgaaaacataaagaaaatcaactccggattcgaagacgtcgagaaacaattctcctacgactccctggtcaaacccctattcctctcccccagcgtcaagaaaatgctctggcaaaccctgaaactcgtaaaagaaatatcgcacatcactcaggccccacccaagaagatcttcatcgagatggcgaaaggagccgaactcgaccccgtccgcacaaagactagactgaagatcctgcaggacctttacaacaactgcaagaacgacgcggacgcattctcatcagaaattaaagacctttcaggcaaaatagaaaacgaggacaacctccgactacggtccgacaaactatacctctattacacacagctcgggaaatgcatgtactgcggcaagcccatcgagataggtcacgtttttgacacgtccaactacgacatagaccacatatacccgcaatcgaaaatcaaggacgacagcattagcaaccgtgtcctagtatgttccagctgcaataaaaacaaagaagacaagtacccccttaaggccgaaatccagtctaagcaacgaggattctggaactttctacagcgcaacaacttcatctcgctggaaaaactcaaccgcctcacaaggacaagcccaatctcggacgatgaaacagccaagtttatagcgcgtcaactcgtcgaaacacgccaagccaccaaggtggccgcgaaagtactcgagaaaatgttccccgaaacaaagatagtatacagcaaggcggaaactgtcagcatgttccgcaacaaatttgacattataaaatgccgcgaaatcaacgatttccaccacgcgcacgacgcatacctaaacatcgtcgtcgggaacgtctataacaccaagttcaccaacaacccctggaacttcatcaaagaaaagcgcgacaaccccaagatagccgacacgtacaattactacaaggtattcgactacgatgtcaaacgcaacaacatcaccgcttgggaaaagggcaaaaccatcatcaccgtcaaagacatgctgaaacgaaacacccccatttacaccaggcaggccgcgtgcaagaaaggggaactattcaaccaaactatcatgaagaaaggactcggccaacaccccttaaagaaggaaggtcccctatcaaacatctccaaatacgggggatacaacaaggtcagcgccgcttactacaccctcatagaatacgaagaaaaaggctccaagatcaggagcctcgaaaccatacccctctacctcgtaaaagacatccagaaaaacaaggatgggctcaagtcctacttgaccgaccaaataggcaagaaagaaataaaaattctcataccgaagataaagatcaacagcctcctgaagattaacggattcccctgccacataaccggaaagatgggtgaagcgttcgtcctccgccccgcagtacaattctgctgttccaacgacgaagcattatacttcaagaaaataatcagattcaacgaaatacggaaacaacgggagaaaatggggaaaaccatctccccgtacgaagatctgtcattccgctcatatatcaaggacaacctctgcaagaaaacaaaagcggacgagatcgaagaaaaagagttctacgacctactacaaaagaaaaacctcgagatctatgacatgctgctcaccaaacacaaagacactatctacaagaaacgccccaattctgcaacgatcgacatcctagtaaaaggcaaagaaaaattcaaaagcctgataattgagaaccaattcgaagtcatactagaaattctgaagctctttagcgcgacccgaaacgtcagcgatctgcaacacataggcggcagcaagaacgcgggcaacgctagggtcgggaacaaaatatcatccctcgacaactgcatcctgatataccaatccatcactggcatcttcgagaaacgtatagatctactcaaaatttga

SEQ ID NO: 6753 - RNA, 4188 nt, synthetic construct
  misc_feature 1..4188: note = Cas9 variant
  source 1..4188: mol_type = other RNA
atgaagaaagaaataaaagactatttcctgggtctcgacgttgggacaggctccgtcggatgggcggtcactgataccgattacaaactactcaaagctaataggaaagacctatgggggatgaggtgctttgaaacagcggagactgccgaagtccgccgccttcaccgaggagcccggcgccgtatcgaaagacgaaagaaacgcattaagctactgcaggaactgttctcccaagaaatagcaaaaatcgacgaagggttcttccaacgcatgaaggaatccccgttctacgcggaagacaaaaccatactgcaggaaaacgccctcttcaacgacaaggacttcacagataagacgtaccataaagcctacccgacgatcaaccacctaataaaagcctggatagaaaacaaagtaaagcccgacccccggctattgtatctagcctgtcacaacataatcaagaaacgcggccacttcctattcgaaggagatttcgacagcgaaaatcagttcgacacgagcatccaggcactcttcgagtacctacgcgaagacatggaagtggacatcgacgcagactcccaaaaagtcaaagaaatactaaaagacagctccctcaaaaactccgaaaaacaatcccgactgaataaaatactggggttaaaacccagcgacaagcaaaagaaagcaatcaccaacctcatcagcggcaataaaataaacttcgcagatctctacgacaaccccgacctcaaggacgccgagaaaaactctatcagtttctccaaagacgacttcgacgccctatccgacgatttagccagtatcctcggcgactccttcgaactcctactaaaagccaaagcggtatacaactgctccgtcttgtccaaggtaataggcgacgaacaatacctctcgttcgcgaaagtaaaaatctacgaaaagcacaaaaccgacctcaccaaactaaaagccgtaattaagaaacacttccccaataactacaagaaagtcttcggctacaaccaagataacgaaagcaaaaacaactattcaggatacgtcggcgtgtgcaaaactaagaacaagaaattagtaataaacaactccgtcaaccaggaagacttctacaaatttctcaaacccatcctttccgcgaagtcagaaatcaaggaagtcaacgacatccttgcagaaattgaaaccgggaacttcctccccaaacaaatttccaaatctaacgccgagataccataccaactccgcaagatggagctagagaaaatcctaagcaacgcggaaaaacacttctccttcctgaaacaaaaagatgaaaaaggtctctcccactcagagaaaatcataatgctcctgacgttcaaaatcccctactacatcggccctatcaacgataaccacaagaaatccttccccgacagatgctgggtcgtcaaaaaggaaaaatccccttcaggcaaaactactccatggaatttcttcgatcacatcgataaggaaaagacagctgaagagttcatcacatcccgcaccaatttttgtacctacctaatcggggaatcagtactgcccaaaaactcgctcctttatagcgaatacaccgtcctaaacgaaatcaacaatttgcaaataataatcgacggtaaaaacatctgcgacaccaaactcaagcagaaaatctatgaagacctgtttaagaaatacaagaaaatcacccaaaaacaaataagcacgttcatcaaacacgaggggatctgcaataaaacagacgaagtcattatactcggaatagacaaggagtgcacatcctccctgaaatcttacatcgaactcaagaacatcttcggcaaacaagttgatgagatctcaacgaagaacatgctggaagaaattatacgatgggcaaccatctatgacgaaggggagggcaaaacaatccttaaaaccaaaatcaaggccgagtacggaaaatactgttccgacgagcaaattaaaaagatactcaacctcaagttctcagggtgggggcgactcagccgaaagttcctagaaacggtcaccagcgagatgcccggcttctcagagccggtcaacataatcacagccatgcgcgaaacccagaacaatctcatggaactactttcatctgagttcaaattcacagaaaacataaagaaaatcaactccggcttcgaagacgccgaaaaacaattcagctacgacggcctagtcaagcccctattcctctctccctccgtaaagaaaatgctgtggcaaactctaaaacttgtcaaagaaatctcacacataacacaggccccacccaagaaaatcttcatagaaatggcaaaaggtgccgagctggaaccagcacgcacgaaaacgcgcctcaaaatactccaagacctctacagctcctgcaaaaacgacgcagacgccttcagctcagaaatccagtacctgtcgggcaagatagagaacgaggacaacctgcgcctccggtcggacaaactgtacctctattacacacaactcggcaaatgtatgtactgtggcaagccgattgaaataggccacgtcttcgacacctccaactacgacattgaccatatttacccgcaatcaaaaataaaggacgactccatctccaacagagtcctcgtatgcagctcatgcaacaaaaacaaggaagacaagtatcccctaaagtcggagatccagagcaagcaacgcggtttctggaatttcctccaacggaacaacttcatatcgctggaaaaacttaatcgcctcacacgcacaaccccgataagcgacgacgagacggcgaaattcatcgcacgacagttagtagagacccgacaggcaaccaaagtagcagccaaagtcctcgagaaaatgttccccgaaacgaagatagtatacagcaaggccgaaaccgtctctatgttcaggaacaaattcgacatcattaagtgcagagaaataaacgacttccatcatgcgcacgacgcgtatctcaatatcgttgtgggcaacgtctacaacacaaaattcaccaacaacccgtggaacttcatcaaggagaaaagggacaacccaaaaattgccgacacctacaactactacaaggtattcgactacgacgtcaaacgcaacaacataaccgcatgggaaaaaggcaagaccatcatcacagtcaaagatatgctaaaacgaaacactcccatatacacacgccaggcagcctgcaagaaaggcgagctattcaaccaaacgataatgaagaaaggccttggacagcacccacttaagaaagagggcccatttagcaacattagcaaatacggcgggtataataaagtgtccgcagcgtactataccttaatagaatatgaagaaaaagtaaacaaaatacggtctctcgagaccataccgctctacctagtaaaggacattcaaaaagaccaagacgtcctcaagtcctatctaaccgacctcctcggcaagaaagaaatcaaaatcctcgtgccgaaaataaaaatcaacagtctattaaagataaacggctttccctgtcatatcaccggaaaaacaggagacagcttcgttctgcgcccagcagtacaattctgctgctccaacgacgaggtcctctacttcaagaaaatcatcaggttcaacgagatacgatcccaacgcgagaaaatgggcaaaaccatcagcccgtacgaagacctgagcttccgctcatacataaaggaaaacttatgtaaaaagacaaaagcggacgaaatcggagagaaggagttctacgatcttctccagaaaaagaacctcgaaatatacgacatgctcctcaccaaacacaaggacaccatatacaacaagcgccccaattcaaccaccctcggcatgctcacaaaaggccgctacgagttcataaacctcaaacctaaagaccagattatcgtcatgctggaaatcctcaaactattctgcacgacccgcgaagcaatcgacctcggtctcatcaaaggcaagcccgctgcaggcgtagccacgcttggtaagaaaatcagcaatctggacaattgcatcctcatctaccagtcgattacagggatcttcgaaaaacggatagacctcctaaaagtgtga

SEQ ID NO: 6754 - RNA, 4188 nt, synthetic construct
  misc_feature 1..4188: note = Cas9 variant
  source 1..4188: mol_type = other RNA
atgaagaaagaaatcaaggactacttcctcggcctcgacgtgggcaccggaagcgtcgggtgggctgtcactgacaccgattacaaactactcaaagcgaacaggaaagacctgtggggaatgcgatgcttcgagaccgcagaaaccgcagaagtgcgacgccttcaccgcggcgcaagacgtaggatagagcggcgcaagaaacgcatcaaactcctccaggaactattcagccaggaaatcgccaaaatcgatgaaggcttcttccagcgaatgaaggaatcacccctatacgccgaagacaagacaatcctccaagaaaatacactcttcaatgacaaggacttcactgacaaaacctatcataaggcgtacccgactattaaccacctcatcaaggcctggattgagaacaaagtaaaacctgaccccaggctcctatacttggcatgccacaacataattaagaagcgaggccatttcttattcgagggggactttgatagtgagaaccagttcgatacctccatccaagcccttttcgaatacttacgagaagacatggaagtagacattgacgccgactcccagaaagtcaaagaaatcctaaaagactcctccctcaagaactctgaaaaacaatcccgccttaacaagatgctaggcctcaaaccaagcgataaacaaaagaaagctataaccaacctcatctccggcaacaaaataaacttcgccgacctgtatgacaacccagacctaaaagacgccgagaaaaattcgattagtttcagcaaggacgactttgacgcgctttcggatgacctcgcatcaatactcggagattccttcgaactactcctcaaagcaaaagccgtatataactgctcagtactaagtaaagtaataggcgacgaacaatacctatcgttcgccaaggtaaagatatacgaaaaacacaagaccgacctaacgaaactaaagaatgtaatcaagaaacacttccccaaagactacaagaaagtattcggatacaacaaaaacgagaaaaacaacaacaactactccggttacgtgggcgtttgcaaaaccaaatccaagaaactaatcatcaacaacagcgtcaaccaagaagacttctacaaattcctaaagaccatcctatccgccaaaagcgaaatcaaagaagtgaacgacatcctcaccgaaatcgaaacaggcacattccttcccaaacagatctcaaaaagcaacgccgaaatcccctaccagctaagaaaaatggagctagagaagatactaagtaatgccgaaaaacacttctccttccttaaacaaaaagacgaaaagggactatcacactcagagaaaatcattatgctcctcacgttcaaaatcccctactatatcggccccatcaacgacaaccacaagaaatcctttcccgatcgatgctgggtagtcaagaaagagaaatcaccctccggaaaaacaaccccgtggaacttcttcgaccacatcgacaaagagaaaaccgcagaagagttcataacctcccggacgaacttctgcacgtacttaatcggcgaaagcgtcctacccaaaaactcgctactgtacagcgaatataccgtcttgaacgaaataaacaacctgcaaatcatcatcgacgggaagaacatctgcgacaccaagctaaagcaaaagatctacgaagaactcttcaagaaatataagaaaatcacccaaaaacaaataagcacctttatcaaacacgaaggcatctgcaacaaaacagacgaagtgattatcctaggcatcgacaaagagtgcacgagctcgttaaagagctacatcgaactcaagaacatcttcggaaagcaggtagacgaaataagcacgaaaaacatgctagaagaaatcatacgctgggcaactatatacgacgagggagaaggaaagactatcctgaaaaccaaaatcaaagccgaatacggtaaatattgctccgatgaacaaatcaagaagatacttaacctcaaattcagcggttggggccgactgtcgcggaagttcctcgagaccgtaaccagtgaaatgccaggattctccgaaccagtcaacataatcaccgccatgcgtgaaactcaaaacaatctaatggagcttctgagcagcgagttcaaattcacggaaaatataaagaagataaacagcggcttcgaagacgtcgaaaaacagttctcatacgatggactggtcaaaccactctttctatcaccgagcgttaagaaaatgctgtggcaaaccctcaagctagtaaaagaaatctcccacatcacccaagcaccgcccaagaaaatcttcattgagatggccaaaggagcggagctcgacccagtccgaaccaaaacgcgactaaaaatccttcaagatctgtataacaactgcaaaaacgacgcagacgcattctccagcgaaatcaaagatctctcgggcaaaatagagaacgaggacaacctccgcctccgcagcgataaactctacctgtactacacacaactcggaaaatgcatgtactgcggcaagcccatagaaatcggacacgtattcgacacctccaactacgatatagaccacatatacccccagtcaaaaatcaaggacgactcaatctcaaacagggtgctcgtatgcagctcatgtaacaaaaacaaggaagacaagtaccctctcaaagccgagatccagagtaaacaaagggggttctggaacttcctccaaaggaacaacttcatctcgctagagaagttcaacagactcacccgcgcaacccccatctccgatgacgagacagctaagtttatcgcacgtcagctcgtggagactcgccaagctaccaaagtcgccgctagagtcctagagaagatgttcccagaaaccaaaatcgtctactccaaggcagagaccgtatccatgttccgcaataaattcgacatcgtcaaatgccgagaaatcaacgattttcaccacgcccatgatgcctacctgaatatagtagtcggcaacgtctacaacaccaagttcacgaacaacctatggaacttcataaaagaaaaacgcgacaacccaaagatcgcagacacgtacaactactataaagtcttcgactacgacgtcaagcgtaataatatcaccgcctgggagaaaggcaagaccataatcactgtcaaagacatgctcaagcgaaacacacccatctacactcggcaagccgcgtgcaagaaagggggactattcgatcaaacaataatgaagaagggcctcggccagcatccactaaagaaagaaggaccgttctccaacatatcaaaatacggaggatacaacaaagtctcagcagcgtactacacccttatcgagtatgaggagaagggcaacaaaatccgcagcctggagacaataccgctctacctcgtgaaagacatccagaaagaccaagacgtcctaaaatcctaccttaccgaccttctagggaagaaggagttcaaaattctggtgcccaaaatcaagatcaacagcctactaaaaatcaacggtttcccctgccacatcaccggcaaaacgaacgactccttcctcctccgccccgccgtgcagttctgttgctctaacgacgaagtgctctacttcaagaaaatcatccgtttcagtgagatccgctcccagcgcgagaaaataggaaaaactatctccccatatgaggatctcagcttcaggagctatatcaaagagaacctatgcaaaaagaccaagaacgacgaaataggcgagaaggagttctacgacttacttcaaaagaagaatttagaaatctacgacatgctccttaccaagcacaaggacaccatctacaagaaacggccaaattcagcgacgatcgacatactcgtcaaaggcaaagaaaaattcaaatcgctgataatcgaaaaccaattcgaagtcatactcgagatcctcaaactattcagtgccacccgcaacgtaagcgacctacagcacataggcggctccaaatactccggagtcgccaaaatcggcaacaaaatcagcagcctagacaactgtatacttatctaccaatcaattacaggcatatttgagaagcgaattgacctcctaaaagtgtga

SEQ ID NO: 6755 - RNA, 4191 nt, synthetic construct
  misc_feature 1..4191: note = Cas9 variant
  source 1..4191: mol_type = other RNA
atggactcctcgaaacaaggcctacgacgctaccacctcggcctagacattgggaccaacagcatcggctggactgccatagacgaccacttctcccttctccgcgtcaagggcaaaaacgccataggagtccgcacctttaaagaaggcgaaacagccgcagatcgccgcgggttcagaaccgcccgccgccgccttagccgcaggcgctggcgactccaatttctggatgagttctttgcaccctacctggcagaagtcgaccctaacttcttagcccgactcaaacaatcagacatttccgctaaggaccccgccaaaaaccaagaatacatgggaaagctactcttcccggaccaagaagccgcctcagacgggaatggatacccaactctaatccaaatgcgtaaagcaatgcccgccgaaaaagcggcagacttccccgtgtttaacatataccaacttaggtacgcgttgatgaacgaaaagcgaaaattcgacctccgtgagatctacctagcggtccaccacatcgtaaaataccgcggcaacttcctcaacaacacttcggtcgataagttcaaggcagaccagatcgacttcaacaaatcatttgaaaccctaaacgatttgttccgccaggtacaacccatcgcgccattccaaatagacctcacaaaagtcgacgaactgggcaaactgctcctagacactaaacaaaagaaactcgaccgccaaaaggccgtagccaaactactacctctaatcgaagatggaaccgacaaagagatagttaaagctcaccaacaaacggcacgcgaaatctccaaactcatcctaggatacaaagccaaagtaggactaatcctgcaaaacaacctcgaccaaacccttgacatgtccaccgagaactccgacgaccaactaatgcagatcgcagaggaactagacgattaccaaatggaactgataaatcagttgtccctactatacagccaaataatgctcaacgaaatagtccccaacggcgaaaccgtatcagcctccatgctgaaccgatactataagcaccgatgccaactgaaagaactaaaagactacggtgcagcccaggacaagaaaactcgagagcaactcgaccacctctacgccgaatacatcggccagataccaaaagattccaaattcgatttcaccaaagatctgaaaaagctaatggataaatcagacctcggccaaaagatcaaagacgagatcgaagccggtgactacctcccgaaacagcgtaccagtgccaatggagtaatcccccaccaaatgcaccaacaggaactagatcaaatcatagaaaatcaaaaagaatactacccctggttagctgaacccaacccagtcgagaaaaacatcaagaacgcaaagtacaaactggaccagctagtgagcttccgtgtaccatactacgtcggcccaatgatcacactagccgaccaacagaaaacaagcaaagcctccttcgcctgggccgtccgaaagaaagcgggaaaaatcaccccatggaacttctatgacatgatcgaccgagaaaagtcagcgaacaactttataaagcgcatgacaaataaagacacatacctgctcagcgaagacgtcctacccgccagcagcttactctaccaaaagtttacggtcctaaatgaactaaacaacatacgtgtaaatggtagaaaactgcaaccggcactcaaacaagccatatatacagacctctttcaaaaacggaaaacagtaaacctcaaaaccctcacgaacttcctcgcgatacacgaaccaacactcacaaaacccaaaattgaaggtctatccaacggcagatccttcaattcatctctaggcacatacatagacatgtcaaagatactcggtgactcactggacgacctcaattacagagacgacatcgaaaagatcatcgagtggagcacggtgttcgaagactccgagatctacggggtgaaactgcaagaaatccaatggctaacaaacgagcaacgggaaaaactcgtacgaaaacgataccaaggttggggccggctaagcaagaaactcctcacgggaataacagatgaaaacggccaaagaataatcgacttaatgtgggacacgtccaaaaacttcatgcaaatagtacatcaaccggtattcgaggaacaaatcgcagagctcaatcaacagctgctccaagatgccgacaaagcaccgcttgaagtggtagatgacatcctagcagacgcgtatacatcaccccagaacaagaaagcgatacgccaggtggtcaaagttgtggccgacgtcgtcaaagcagtcggtaatgcgccggcctcaatctcgatagagttcgcgcgcaatgaagaccgcaacaaagaactcaagaactcccgacggcacagcatcgagaagttatatcacgaaacagctgaaaaattggtgaaacaaaccaacctactcgaggaactaggcaacgtaaaagacctgaacgaccgctactacttgtacttcacacaagcaggacgagacatgtacgatggaacccccatcaatatcgacgaaatcagcacacactatgagatcgaccacatactaccgcaatccttcctcaaggacaactccctcgacaaccgcgtgctagtcaagaaatccgaaaatgccgcaaaaagtgaccgggtccctgccaaactatatggtgccaagatgcgggctttctggaagcagcttaaagagagccaactcatcagtaaccgcaaataccttaacctaacgaccgatcctgaacaagttgacaaatatcagatgcaaggattcgtacaccgacaactcgtcgaaacaagacaaatcataaaactagccgcgaacatctttggctccctctacccggactccgcggtcatcgagaccagagcggaactaaccaagcagctacgcgagaagttctcgctatacaaagtacgggacgtaaacgactaccaccacgccgttgacgcgtacctcaccgccttcgccgggcactatctctaccaacggtatccaaagctgcgacccatgtttgtctacggcgactacgccaaaatctatgctgatgatctaaagagactccgcagcgtaaacttattccacgacctagaaaaggaccaatataactcaggcactgcggtaaacccggaaacaaaagagaagatcgtcgatgtagactggctttccgactacgtgtccaagattcagcacttcaagtacatgctgatatccaaagccgtatacacccagcacgggcaactatacggggcaacaatcctcccggtcgcccaagtcgacaagatatccgcacccattggcatcaaagacgacaaacctgtggacatttatggtgcatacaccaacgaggtcgccgcttacatggccatcgtaagagtcaatgggaagaaacccaaatacaaagtggtatcagtcccagtcagaatgctacaaaggctcaaaatggcagaacaaaagggccacgaccagtacatgcaaaccctccacgacgtactcctacgcaatttcacgtcgctaaagaagaaccgaaaaacgggcctcaaggaggccgtagtcaaagacttcgacgtcctggttccatgcgtccgatacaaccaactcgtcattgacggcgacaccaagttcaccctaggttccgccacctaccagcacaacgccaagcaattagttttatgcaaccactccctcgaaaccctagccaacaacttcgaatacgttcgcaaacaccccgatgaggccgacgaacgaatgatcatgctatacgacgacatactggaccaagtaaaccactacttcacgctgtacgacaaaaacaaatttcgcgaaaaactcaacgcaggccgcgataagtacctcaaactcccaaccttcagccaattcgaaaacaacaaaaagacggcaatagggaaaagcgaagcgatcatcaacatactacgtggtttacatgccaacgcggccataaccaacctgaaatgcctcggcgtctctacccctttcggtcaactacagtccccctcagggatcgaactgagcgagaacgcgaagctcgtgtaccaatctccgaccggcctattctcccgcgaagttctgctcaaagacctctga

SEQ ID NO: 6756 - RNA, 4191 nt, synthetic construct
  misc_feature 1..4191: note = Cas9 variant
  source 1..4191: mol_type = other RNA
atggcaaatctccgcaattacaagggcgactataacatcggcctagacatggggacaggtagcgtcggttgggcggtgacggatagcgaaggaaaactcctgcacttcaagaaacaacccacctggggctcaagactcttcgacagtgccgaaaccgcagccagtgcccgcattccacgaggccagaggagaagatatgtaagaagacggtggagacttgacctgctacaacaactcttccaggatgaggtgtcaaaggcggaccccgagttcttcatccgactccgacaaagcagactgctcaaggaagaccgtgaagaaggacatagagactataaccaccccctctttaacgactccgatttcacagaaaccgactactacaaccggttcccaacaatttaccatctgcgaaaatggctaatggagacagacgaaaaagccgacataagactcgtatacctagcagctcacaacattgtaaaacaccggggcaatttcctgcgccaggaaaacacttccctatccgcgaaaaatgcacggccgttagacgcactcagagagttccgctccgccctagtcgattggtgcgccgaattgggttacgaatgtaaccccgacgaaagcggcgaaataagtaacgaaatcctatcagttctcgaagaagaacacgtggccaactcagacaaaaagaaaagaatcagcagtctgataggcgtcgcaatgaatgagggagcaaaagaatcgaaggcatgcaacgatgcgttagcaggagccatggtgggactaaaggcggagttcaaaaacgtattcggcgaaatcagcgcagaacagacctccatctacctaagcaacgacgaggccgtagacgctctcagagaaggaatccccgacgaaggcctcgaactcttcggaaagctctgcagcgtgtatagcgcgtatgtactacaagggctactaagctatgcccccggccaaacaatatcagtgaacatggtcgctaaatacgaaaagtacgggaacgacctcaaaacactcaaggccctggtatgcgaatacgcaagggccgaatatgactcgttctttaggggagagttctaccgcgaccaagacggacacgaactgaacatctataacgcgagcaaggcacaagggtatacgcgttacaacctggggacgagcaaaatgtcgtacgaggacttcgaaaaagccgtaaagaaactgttcgccggaacggcagccgaggaagacggtcgatacctacaaatgatgaaagagttcggagagcagagattcctaagaagactaaaaacatccgataacgggtcgatctactaccaactgcatctcgaagaacttacggcaatccttagcaaccaaggaaaacactaccccttcctcgtagaagacgcagagaaaattaagtcgctagtctccttcagaataccgtactacgtcgggccactcacagaccgaaacgcccgaaaggacaaacacggcaagaataggttcgcatggagcgaaagaaagtcgggaatggaagacgctgtaattaccccctggaactgggacgaagttatcgaccgaggaaaaagcgccgaagcgttcatcacccgcatgacagggatgtgcacatacttacaaggcgaagatgtgctaccaaaatgcagtctcttatacgaagagttctgcgttctaaatgaactcaatgggagccgatggggcatggacggcgacaaggaacatcgcttcgacgcagccgaccgagaagcaattattgaagaactcttcaagaaaaagaaaacagtaaaatacaaagacgtcgccaactggttggaaagagaagccgggagaatgaacgttcacgtcatgggcggccagggcgaaacgggatacgaatcaaaactaagcagttactacttcttcagacgcgatatattcgatgtcgaggaactagaccgagcggactatccaatgatcgagcaaataatactctggaacaccctgttcgaagaccggagaatactcaaagaaaaactggaggatgcatacggaccaaaaggaaacggcagactggacgacgaccaaatcaaaaagatatgccgaaaacgtttcacaggctggggccgactctcaaagaaattcctcacaggcataaaggtcgacacagattgcggcccccgttcaataatggatgtcctaagagaaggagacccaaacgccggcttccgaggtaaaaccatggtcatgatggaggtcctacgagacgaaaacttgggttttcagcaaaaagtcgacgagttcaacaaaaactacttcgggcaaaaaggaaaagcgctcgaagtaaatgaactcccaggtagccccgcaatccggaggagcctcaaccaggccatacggatagtcgatgaaatagcaaaaatcgcgggaaaagacccagaatcaatcttcatcgaagtaacaagggatgacgaactggacaaaaggggtaagcgcaccaagagacgatacgacgccctgaaggaggcgttaacagtctttaaaaaggaggatccggagatctgggcagaactccaagccaccagcccgagcgacctcgacgaaaggctcaccctttatttcatgcaaaggggaaagtgcctctacagcggagagccaatcgacatcaataaactttcatcgggcgaatatgaagtagatcacataataccacgctcgtacataaaagacgactctctagaaaacaaagcgctcgtttgtagaaagtataaccagtccaagacagacgccatgctcctcgacccgtcgatacgcaggaaaatgcgatcatactgggacatgctcttagacgcaaaattgatcgggcccaagaagcaccggaacctgctccgagaccacatcgacgaaaaagcaatgaaaggcttcgtagcccgacagctagtcgaaacatcacagagtgttaagctcgctggcagcctactcagcgtccggtacccgaacgccaacatagtcccagtaaaggccagcatgagccacgatctccgagaagccgcaggattcgtaaaatgcagagaagccaacgacttccaccatgcgcacgacgcctacctagcatgccggatggggctatttatacaaatgaggcaccccaaagtgtacgaaaacccaatagcaatgacccgagtcatgcaaaaatacgcccaacaacagtcaaaagagttcaaccgcaaccaccgagtccccgggacaagcggctttatcgtcaattctttcatgagtagcggattcgacaaagaaaccggagaaatattcaaagacacctggaatgcagaaacagaaatagaaggaatacgcaaagcgctgaattacagacagtgctacatcagcagaatgccaatggaagatacgggggcgttctggaacgccacagtatactcccccagagaccccaaaatggggccgaaattggccctgccgctaaagaaagggctggaccccaaaaagtacggaggattttcgtcgcagcagtttgcatatttcttcgtctacgaagcacgggacaagaaggacaaacaggtgttccgcttcgcagaagtgccagtctggctagcgtcgcagatagagagcgacaagatcgccttggaacgctacgcaacgggactagccgaagcagagaagctaaaattcgtgagaatcgagcgtgcaaaaatcttaaagaaacagctcatcgaaatagacggagaccgatttatactgacgggaaagaaagaaatgagaaacggcagggagctcgccctgtcacaaaaagaaacacttaacctcatagtcgccggagatgagaacgcgagcttagacgaccgaggaaacgcttcggacgcggtattcgacgcgatcgttcgacagggcgacgagataggactacgcctgtataaacagctaaaaatcgcagaaatagcagagagataccgctcggtgggtgcagatgccaaagtcggggcggtgatgagtctcctaagctcaattaacgccagcagcaacatggtgaacctatctatggtaggcggcagcaaatacgccggcaacttacagccaaattacagcaatctcctttcagaccccgagacaaacttcgtgataatagaccagagcgtaacaggcatgttcgaacgccgaacaaggatagggctatga

SEQ ID NO: 6757 - RNA, 4191 nt, synthetic construct
  misc_feature 1..4191: note = Cas9 variant
  source 1..4191: mol_type = other RNA
atgaccaagccgtacagtataggactcgacatcggcaccaactcagtcggctgggccgtaatcaccgacgactacaaagtgcctgcaaagaaaatgaaagtactgggcaacaccaaccgtgactacatcaagaaaaatctactcggagccttactcttcgatggcggcgaaaccgcagaaggacggaggctaaaacgtacagcgagacgacgctacacgcggcgcaaaaatcgcctgcggtatctgcaggaaatattcgccgaagagatgatgcaagttgacgaatcattcttccagcggctcgacgacagcttcctagtcgaagaagacaaacagggaagcaaataccccatcttcggaaccctcaaggaagagaaagaatatcacaagaaattcaaaacaatctaccacctccgcgaggaactggccaactccaaagagaaagccgacttgcgtctcgtatacctagccctcgcgcacatgattaagttcagagggcacttcctttatgagggggatctaaaagcagaaaacaccgacgtccaagcgctattcaaagacttcgtagaagaatacgataagacgatagaagagagccacctaagcgaaattacagtcgacgccctatcaatccttacggaaaaggtcagtaaaagcagccgcctcgagaacttaatagcccactaccccacggagaaaaagaacaccttattcgggaacctcatcgccctatccctgggcctccaggccaacttcaaaaccaacttccaactcagcgaagacgccaagttacagttctcgaaagatacctacgaagaggacctcgagggcctactaggcgaagtaggggacgaatacgcagacctattcgtgagcgccaaaaatctatatgacgcaatcctactctctggaatacttacagtagacgacaacagcaccaaagcacccctatccgcgtcgatggtcaaacgctacaaggaacacaaagaggaactggcggcattcaaacgcttcatcaaagaaaagctgcccaagaaatacgaagagatatttaaagacgacactaaaaacggctacgcgggctacgtcggcgcagacaagaaactccgcaaacgctccggaaaactagccaccgaagaagagttctacaaatacgtcaaaggcatactcaacaaagtcgaaggggcggactacttccttgacaaaatagaccgggaagacttcctacgcaaacaaagaactttcgataacggctcgataccacaccaaattcacctccaagaaatgcacgcaatactcaggagacaaggggaacactaccccttcctcaaggaaaatcaggacaaaatcgaaaagatactcacgtttagaatcccctactacgtaggccccctggcccgaaaaggcagccgattcgcctgggccgaatacaaagccgacgagaaaatcacgccatggaacttcgacgacatactcgacaaagaaaagagcgcagaaaaatttatcacaagaatgacactgaatgatctttacctacccgaagaaaaagtgctaccgaaacatagccccctatacgagacgttcacagtatacaacgaattgaccaaggtcaagtacgtcaacgagcaaggggaagcgaaattcttcgacacaaacatgaaacaggagatcttcgaccacgtattcaaggaaaatcgcaaagtaacgaaagacaaactgctcaactacctcaacaaggagttcgaagaatttcggatagtaaacttaaccgggctcgacaaagagaacaaggcattcaacgcctccctcggaacctaccacgacctcagaaaaatactagataagagctttctggacgacaaagttaacgagaaaatcatcgaagatatcatccaaaccctgacccttttcgaagacagagaaatgatccgccaacgtcttcaaaagtactcagacatattcactacccaacaactaaaggaactcgaaagaagacactacacaggatggggaagactatcgtacaaactcatcaacggcatccgcaacaaagaaaacaagaaaaccattctagattacttaatcgacgacggctacgccaacagaaacttcatgcaattgatcaacgatgacgcactatccttcaaagaagagatagcccgggcacaaataatcggcgacgtggatgacatagcaaatgtagtgcacgacctcccaggatccccggcgatcaagaaaggcatcctccaatcggtcaaaatagttgacgaacttgtaaaagtaatggggcataacccaaccaacataatcatagaaatggcccgcgagaatcaaaccacggacaaaggccgccgtaactcgcaacagcgactcaagctcctacaggacagtctgaaaaacctagacaacccagtcaacatcaaaaacgtcgaaaaccaacaactccagaacgacaggctatttctatactacatacagaacggtaaagacatgtacacgggcgagactctcgacatcaacaacctcagccaatacgacatcgaccacataatccctcaggcctttattaaagataactcgctggacaaccgcgttttgacccgcagcgacaaaaacagagggaagagtgacgacgtaccctccatagaagtagtccacgagatgaagtccttctggagcaaattgctctcagtaaagctgataacacagcgaaagttcgacaacctcaccaaggccgaacgaggaggactgacagaaaacgacaaagccggattcattaaacgccaactcgtagagacccgccaaatcaccaagcacgtagcgcaagtactcgacgcgcgcttcaacgccaaacatgacgaaaacaagaaagtaatccgagatgtcaaaatcataacactcaaaagcaaccttgtcagccaatttcgaaaggacttcaaattctataaggtacgcgagataaacgattaccaccatgcccacgacgcctacttgaacgccgtcataggcacggctctcctcaagaaataccccaaactcgcaagcgagttcgtctacggagagttcaagaaatacgacgtcagaaaattcatcgcgaaaagcgacaaagaaattgggaaggctacggcgaaatacttcttctactccaatcttatgaacttcttcaagaaagaggtcaagttcgcagacggcacagtcgtagaacgcccggatatcgaaacttcagaagacggcgaaatcgcctggaacaaacaaaccgacttcaagatagtccgaaaagtactgtcatacccacaggtcaacatcgtcaagaagacagaggtccagacacacggactagacaggggaaaacccagaggtttgttcaacgccaacccctcaccgaaaccgaaacccgacagctcggagaacctagttggcataaaaaggaacctagatccgaaaaagtacgggggctacgcaggaatctcgaactcctacgcggtcctcgtgaaagccatcatagaaaagggtgtaaagaagaaagaaacaatggtcctcgagttccaaggcatctctatcctcgaccgtataaccttcgaaaaagacaaacgagccttcctattgggtaaaggctacaaggacataaagaaaatcatcgaacttccaaaatacagcctattcgaattaaaggacggctcccgccggatgctcgcctccatactctccactaacaacaagcgaggcgagatacacaaggggaacgaactattcgtcccccaaaagtttaccacattgctataccatgcgaagcgtataaacaaccccatcaacaaagaccacatcgaatacgtcaagaaacaccgagacgactttaaagagctgctgaactatgttctcgagttcaacgaaaaatacgtcggcgcaacaaagaacggcgaacggctcaaagaagccgtggccgatttcgatagcaagagcaacgaagagatatgcactagcttcctgggcgccgtgaactccaaaaacgcgggactcttcgaactcacaagcctaggatccgccagcgactttgagttccttggagtaaaaattcctagataccgcgattacacgccttcctcactcctaaaagactcgattctaatacaccagtccatcacggggttatatgaaacccgcattgacctaagcaagctaggtgaagactga

SEQ ID NO: 6758 - RNA, 4191 nt, synthetic construct
  misc_feature 1..4191: note = Cas9 variant
  source 1..4191: mol_type = other RNA
atgaagcgcgtaaacgaggactacatcctcggactagacatcgggacaaattcctgcgggtgggctgtgacagacaagaaaaacaacttacttaaactcaggggtaaaacagccataggttcgcacctatttgaagaggggcacacggccgccgacagacgaggattccgaaccacgcgccgacgcctgaaacgacgaaaatggcgcctgcgactcctagaggaaatctttgcggaacccatggccaaagttgaccccggcttcttcgtccgcctccaccaatcctgggttagcccgctcgacaaggaccgcaagaaatataacgccatcgtattccccaccgccaaagaggatcaagcgttttacaaacactacgcaacaatataccatctccgtgacgaactaatgacccaggaccggcaattcgacctaagagagatcttcctggccatccaccacatcgtaaaatacagaggcaattttctgcaagacacaccagtaaaggacttcgaagcctctaagatcgaagtcggcccaatcttgtcgcacatcaacaacgcattcgcggagaagatcgttgaggaccaggatccgatcgaactgaatgttgcaaacgcggccgacatcgaagatgtgatacgaggcaaggacgcagaaaagacagtttacaaactcgacaaggtcaagaaaatcgcgaaactgctcacagactccaccgctaaggaggagaaaaacgtcgccaaacaaatagcgaacgcaatcatgggctacaaaacgcagttcgaaacgatactagacaaagaaatagacaagtcagacaaagcgcaatgggagttcaaactgagcgacgctgatgccgacgataaactagacgccctgctcccggacctggatgaaaccgaccaaacagtagtagcagaaatagaaaaactcttcagtgcaatcacactctccacgatagtcgacgagaacaaaagcctcagtcaaagcatggtcgaaaagtacaagaaacacaaaaaggattacaagaagctcaagaaatacataaacacgctacaggatcagaccaaggccaagaaacttctactggcctatgacctgtacgtcaacaaccgacatggccggctcctcgaggccaagaaaacattcgaagataaaaagaagaagaaagcactaacaaaagacgagttctacaaaatagtgaaagacaatctcgacgattccgacctagcccacgaaatccaacaagaaatcgccgcagacaacttcatgcccaaacaacgcactaactcgaacggtgtgattccattccaattgcaccaaatcgaactcgacaaaatcatagcgaaccaaggaaaatactaccccttcctcgcggccgaaaaccccgtagaggaccaccgaaaacaggcaccatacaaattagacgagctcgtccgcttcagagtcccatattacgtaggcccaatgatcaccgcagacgaacaagagaaaacgtccgggaaatccttcgcatggatggtccggaaagaagacgggcaaatcaccccatggaactttgaacagaaggtcgacagacaagaatctgcaaacaagttcatcaaaaggatgaccatcaaggacacctacctcctcagcgaagacgttctcccagcgaacagtttactttaccaacgattcgaagtcctcaacgaactcaacaacatccggatcaacggcagccgcatttccgtcgacctaaaacaacagatcttcaacgacttattcgaagagaagaaaaccgtcaccgagaagtccctgacttcctacctaaaacaaaacctccacctacccacagtagaaatcaaaggcctcgccgaccccaccaaattcaacagttccctggccagctattaccatctcaaaagcctgcacgtgttcgacaaagaactcgcagacccccaataccaaaaagacttcgagaaaataatcgaatactcttccatattcgaagacaagaaaatattccaggataaactgcacgccgagttcaaatggctgacaccagaacaattcaaagcaatttcaacatggcgcctgcaaggttggggccgcctcagcaggaaactcctcgtcgaactacacgacacaaatggacaaaacatcatggaacagctttgggacagccaaaagaacttcatgcagattgtgacagaacccgatttcaaagacgcgatagcaaaagaaaaccagaacgtgactcgggccaacggagtcgaagaaatccttgcagacgcctacaccagcccagccaataagaaagccatacgacaggtcgtaaaagtagtcgccgatgtagtaaaagccgcgggcgggaagaaacctgcgcaattcgctatcgagttcacaagggaccccgacaaaaacccccaactgtcacacatacgagggacgaaactcctcaaggcttaccaagaaaccgcgggagaactcgtagaccagaaactgaccgactcactcaaagaggccatgaccagtcgaaaactacttaaagacaaatacttcctatacttcatgcaagcaggcagggacgcctacacaggacaaaagatcaacatcgacgaagtatcaaccaactaccagatagaccacatcctaccccaatccttcatcaaggacgactcattcgacaaccgagtcctaacagcaaccccactgaacgcggagaaaagcgacgatgtcccttataagcgattcgcaaataactacgtatccgacatgaagatgacagttggcgaaatgtggaagcactggcagaaggccggaatcatcaacaaacacaaactaggcaacctcctcctagaccccgacagactcaacaaattccaaaagtcagggttcataaaccgacaactggtcgagaccagccaaatcatcaaactcgtgtcagtcatactccaaaacaaatacccagacgcagaaattataaccgtcaaagcaggcgacaactcagccttaagacaacgactgaacctatacaagtcaagggacgtaaatgattaccaccacgccatcgacgcctacctgtccatcatttgcggcaacttcctgtatcaagtctacccgaaataccgcccgtacttcgtttacggtaagtacaagaaattctcacaagaccccgacctccaaaaagaagtgatcaaacacttcaaaggcttcacatttatgtggccgctactccaaaaagacaactccgaacgcaaggcacctgagaaaatcaaggagaataactccgaccgcatcgtcttctacaaacatccggatatattcgataagctgcgaaaggcgtacaactacaaatacatgctggtctcgagagagaccacgacagaaaacagtgggttattcgacgtaacaatctacccccgcggagaacgagaccttgcaaaaacgcgcaaactcatcccgaagtccaacggactcgaccccaaaatatacggagggtacagcggcaacacagacgcctacatggtgatagtaaaaatcgataaaggcaaggaatcaatctacaaagtaatcggcgtcccaatgagagcattagcatcactgaaccgagcaaagaaacaagggaactacaaagaagaactccatcaagtcttggagccgcaaattatgttcgataaaaacggcaaaccaaaaaggtccgtcaagggatttcgcatcatcaaagaccacgtacccttcaaacaagtcgtcctggatggcgataagaaattcatgctgaatagtagtacgtacgaaataaacgccaaacagctcacactcaccccagaaactatgcggatagtaaccgataacctcaagaaaggtgaagaccaggatcaactacttgtaaaagcctacgacgaaatccttcaaaaagtggaccaatacctacccctctttgacgtcaacaaattccgtaactcactacacctgggccgcgcaaaattcctcgacctcgcagtcaacgacaagaaaataaccctcacaaacatcctgaacggcctacatgacaacctcgtgacacccgaccttaagaacataggtattaaaacacccctaggcaaactccaagtaccgagcgggatcgtactcagctcagaggcaatcctgatcttccaaagcccgaccggtctcttcgaaaaacgcgtgaggatcgcagacctatga

SEQ ID NO: 6759 - RNA, 4194 nt, synthetic construct
  misc_feature 1..4194: note = Cas9 variant
  source 1..4194: mol_type = other RNA
atgaaagactacaacatcggccttgacataggaacctcctccataggattcgccgcaatagacgatgacaataacctgatccgcgtaaaaggcaagaacgtgataggcagtcgtctcttcgcagaaggcaagacagccgctgaacgtcgtggtttccgcaccgcccggagacgctacaaccgccgaaagtggcgactaaaactactcgacgagatcttctacgaggaaatcatacatatcgaccccgagttcttcaatcgactcaagcaatccagcatctcccccaaagatgaatccaagaaatacttcggctcactactcttccccgacaaaaccgattcagcctattaccacgatgggaaccaaaccatctaccatctgcggaatcgattagttcaccagaaagaaaaagccgacatacgcgagatctacctggccctgcgccacatcgtaaaataccgcgggaacttcctcgacagcacccccgtctcctcattcgaagccgataacctgaaactggacgagctggtcccggtcataaacgacatgtacgagaacatcgacatagacttctcaatcaacgtggacaacatcagcgagatcgagaaagtcctcctcgacaaccacttgaaatccgcggacaaacaggaccgcctcaaagaacttctctacgacaacccggaataccccgacgacaaagtaaaacaaaaagagatcagcaagtttcgcaaggacctggacaaagagatcatcaaagtaatagtcggttataaatttaacgcatacaagatcgtaaactacatcccagacgacggatccaagttctccttcagcttctccgacgaaagctccgacgataaactcgacgacctctcagaagtcctagatgactcacagatggagattctaaacactctcaaggtgatctacagcagagtccggctgaaccaaataataccaaacggtatgggcctgagcgaatcgatggtggcgaagtacaaccgccaccacgagcaactagaagacctaaaagaactcctcgacgtactcccgaacgacgaaaagcgcagcatagaatacgcgtacacagcctacatagggaacgtggacaaacagaaatacaataacaaccttgtcgcgtcgctcaaggacctcccgataaaaggcgatataaacaagaaaatccaagccgtatttgagtacgcgaaaggtcacatcagctcacaggacttatacgacgtgatcaagacaatcatcatagacaaatacctcgaagacgagagctttgagtaccacgacctagtcgagaggatatccaacgacatcgacaacaaagactatctcctaaagcagcgcagcagtcaaaacggtaatattccccaccaggtgcaccagatggagatggataaaataatcgccaatcaatcccagtactatcctttcctcggagtcctcaacccgaacgaaagccgacgccatatcgcaaagtacaagattagtgagctagtctctttccgagtaccctactacgtcggccccctaataacccccgaagaacaagagaaaacgagcggaaagcacttcgcatggatgaaacgaaaagaagccggaaagataaccccctggaactttgaagagaaggtcgacaaagaagccactgccgcaaagttcatcaaacggctgacagtaaaagacacctacctcctaaacgaagacgtactcccggataactcactactctaccaacaattcaaagtcctgaacgaactcaacatcgtaaaagtcaataacaagcgactcaccctatccgaaaaacaaggcgtctacaacgacctcttcaagaacaccaagtctataacggtaaaaagacttaagaactacctcatctctaactacaaacacctcgaaaacatcgaaataacgggcctttcggacggtgacaaattcaacaatagtctcggaacttacaacgacttcaagaagatcttcggcgcgcgaatcgacgacgtaaactatagcgccgacttcgagaacatcatcgagtggagcaccgtattcgaagaccgctccatcctcaaggaaaaactagagaaagacatcgactggataaccccagaagaaatcaaggccgtagtagccaagcggtacagcggctggggccggctcagcgccaagctcctgactgaacttctggacgatgacggacagcgcatcatcgacatcctgtggaacgattccatcactttcatggaggctgtatccaaaccagaaatcaaagcacaaatccaaaacataaaccgtgactttatcaaggccaccgacatcgaaactgtcctagacgaagcctacacctccccacagaataagaaagctattcgcgaggtctacaagctagtaaaagacatacaaaaagcaatgggaggcaaagccccatcttcaattagcattgagttcacacgatcgcccgaagacaatggcagcgtaaccaaaacccgatacaacaacatgcagaacaaatacaaagaacttggtaaagaactaagtgacgacctcagcgcgcaactcaaagaatacaaaggcagaatggaccaagacaagttctacctctattttatgcagatgggaaaagacctatacgacggcagcaccatcaaccttgacgacctcaactcataccagatagaccatatagtaccccagtccttctataaggacgatagcatcgataaccgtgtactcacacactacacaaacaaccagaagaaaggaaaccatacccctctcaacggcctaaatattgacgcccagacccagaatctatggaaacacctcaacaaactaggcctaatcagcaagaaaaagctccaaaacctatgctttaaagacatcaatcagctctctaagtacacgaaacacggcttcgtgagacgccagctggtagagacctcccaggtcataaagctggtagcaaacatcctcagcgatgagttcgccaacgatgggacaaagatcatagaagtcaaagctaaaatgaactcgctcatgcgcgacacatttaatctatacaaggtgcggcaactcaatgactaccaccatgccgtcgacgcctacctcaccacatttgtgggcaaatacctctacaaacgctacccaaaacttcgatccatgttcgtgtacggagacttcaagaaattctccgccgaagacgacctcaaagatatcaaaacattcaatttcctccacgacataacaaatcccaaagaaagcaacaaagagaaaatatacgacgagaaaagcggcgaactaatcctcgacagaaaacacgccatagaaacaatcaagaaaatataccaatacaaattcatgctcatcgtaagggaagtctcgaccaaaagcggacaactcttcaaacaaaccatttactccgcgaagaaaaccaacggactcaaaagcgccatcccagtcaagtccaacctcgaacccagcatctacggttaccgatccggtaacgtggaccaccacatggtaatcgtgaaaataaagaaagggacgaaatactctttcaaagtcatagggataagcgcccgggccatacaagaattagagatcgccaaaaagatcggtaactatcgtgataaactgtacgaagtagtctcagacaggcttagccaatccatgaaatcggtcgagagcttccgaataatactcgataacataatgtacggtcaacttatcgtagacggaaacgacaagttcacgcttgggagcgcagactaccgaaagaactcacgccaattagtcctatgcaccaacagcctaaaaatactgaaggacgaagactacatgaaccgcctctccgacatacaacgatctaaattgatggttcaagtctacgatgaaatcatcaaaattatgaaaaacaagtactccctcttcatctcgaataccgaaaaactcctggaaaagcgcgatatcttctgcggcctttcgttcgatgagcagaaaatcgtcatctggaaaatcataatcgatctgcataacggccccttcacaaaaatccaagaactaggtatcaataataagatgggcacgtttcaaacaaaacacggcataatcctgaccgaaaatgcaatcgtcatctaccaatccccatccggcctgtttgaacgaaaagtgcgcctaaaagacctttga

SEQ ID NO: 6760 - RNA, 4194 nt, synthetic construct
  misc_feature 1..4194: note = Cas9 variant
  source 1..4194: mol_type = other RNA
atgaaaaaggtcctcggactcgacctaggaaccaacagtatcggatgggcactcgtcaacgaagcaacaaaagaagaaaagaaagaaggaaaatcttcggaaattattaaactgggcgttagggtcaaccccctaaccgtcgacgagaaaaccaattttgaaaaagggcgccccctatcaaccaacgccgaccggaccctcaaaagaagcgcccgaagaaacctgcaacggtacaaacttcgccgacggaacctaatcgaaatccttatcaaaaatggctttataaccaaggacacacccctgacagagaccggcaaggacactacgcaccaaacacttaagctccgcgccaaatccgccaaagaaaaagtagacctcaaagacttcgctaaaatcctcctcaccattaacaagaagcgaggatacaaatcaagccgtaaggtcaacagcgacgaagacggcctcgcaatcgacggaatggccgtagccaaacacctatacgaacaaaacctcacgcccggacaatacgtactaaatctcctccagaagaataagaaatatgtcccagacttttaccggtctgacctgcaagaggaatttaaaaacatatggaacaaccagaaaacatactacttcgacatcctcaccgatactctgttcgaggagttaaaagacaaaaacaaaagccaaacctgggcgatctgcaagaaaccattcgacattgcaggcatcaaacaaatagggaaggcttcagacaaacgcctagaacgctacaaatggagaacagagggcctcacccaaaaacttaacctggagtatcttgcaatagcgctccaagaaatcaataacgacatcaacaaatccagcggctacttaggagccataagcgaccgcagcaaagagctctttttcaacaaggaaacggtcggagagaatctgtaccgccagctagtcaaaaccccacatacctccctccgaaaccaggttttctaccggcaggactacctcgatgagttcgagacaatctgggaaacccaagcaaagttctatccccaactgacacacacactaaaagaagaaatacgcgacgtaatcatcttctaccaacgaaaactaaagtcccaaaaatccctgatcagcttctgtcaattcgagtcatgggaacaaacatacatcgagaaagaaaccgggaaatccaaaacgcgaacagttgggcgaaaagttatacccaaatcgagccccctattccaagagttcaagatctggcagaacctaaacagcctagagttcaggaactccgacgaaggggaaatcatcgaatttatcaaactagatgaagacatccgccagaccgtcttcgaggaactcaacttgaggggcaacctcaaacccaacgacgtccttaagatcctcggcaactacattagcctgggtaaggtatcacaatggaaatgcaatttcgaggaaatagaggggaaccgtaccaacgcagcactctacaatgtctatcaaataatcgcggaaaacgaaggctatgggttcgactgggccaagaaaaccgcatcggaaatcaacaaagaactcaagaacatcttcccccaactcggcatagacgcatcaatactcgactttgactttacccaagccaacttcgacaaacagacctcctaccaactgtggcatctgctctacagcgctgaagaagacttcaaaataagcgaagaagacaaagtactatacggtaattcgagcgtcagcctcaaaaagaaactacaccaaaaatacggctttaaacccgaatacactaaacttttaacaaacatatcactccagcccgactacggcaacctctcagccaaggccatctgtaacatactgccctacctgaaagaaaataacgtttacagcgaggcttgcgacctcactggctataatcactccaatttcctaaccgccgaagaacaggccaaacgaccactcaaaccgatattagaactactcaagaaaaattcactacgaaaccctgtagttgagaaaatactcaaccaaatggtaaacgtagtcaaccaagtcattgagacgtacggaaaacccgacgaaatacgcatagaactcacccgcgaactcaagaaaagcgccaaggagcgagcgaacatgacaaaatctattgccgacgccacccgcagaaacgatgattacaggaaaacgatcatcaaagaatttggcatcccaaaccccacaaaaagcgatgtcgtccgataccgcctctggcaggaactcgcctcacgcggatacaaggacatcttcactgacaccgagatcaaaccccaagaactgttctcgaataaaatcgacatcgaacacatcataccaaaagccctactgttcgacgactccttctctaacaaaactctcgccttcaaaaaggacaacctcaagaaggccaacagaaccgcgtacgactttatagccaatgactacgcaccaaacctcgaaaattacatagaacgagtcgagtcgctacataaggaccgaaaaataactcgggcaaagcggaacaaacttctaatgctgcagtccaagttaccggacggattcattgaacgagacctccggaactcccaatacatcaccaaagaagccaagaagatgctgtacgaagtatgccgcactgtcgtctcaacaagcggatcgataacggacaaactacgcgaggactgggacctcatcaacgtcatgaaggaattaaacttcccaaaatataaggcattaggcctaaccgagaaaatcgaacggtatgacatcggcgccgagaaaatgaaagaagtcgagatcatcgaagactggaacaagcgtaatgatcatcgccaccacgcgatcgacgccctcacagtcgcattctccacgcactcacatatccaatacctaaaccacctgaacgcccgcagagatgaaggccataagaaacacgcagcaatcatagccatcgagtcgacaatcacagaaaaagagggaaacaagaaacggcgcttcatcgcgcctttgcccaacttccgtctccaggcaaaagaacacatcgaatcaatcctggtgagctttaaaaacaaaaataaagtagtcaccaacaacataaacaagacaaaacgtatcaagaaagacaaattcaacaccaaagtccagctaaccccaaggggccaactccacaaagaaaccatatacggaaaaataaagcaaccattagaaaagcacataaaactaaacaaatccttcacgctcgagcaagccaaactcatcatcgacaagcgccagcgggaaaaagtacttaaccacctcgagaaatacgcgcacaacagtgacatcgccttcaactcgaaaaccctaaagaaaaatccactactaatcagcgacgaacccctgaaggaagtactctgctttgaggaagttttcactatacgcaaagacatctcatacgacaacttcaagaatgagaaacaactcgataaggtcatcgatgagaaggtgaagcaggccctcaaagagcgcataaaccagtacaatggcgacttccgtgaagccttcagcgatatcgagcggaatcccatctggctaaacaaggcaaaaggcatctgcgtcaaacgcgccactataaaaggcgtctcgaacgccgaaccactccatacggccaaaaaccacctaggagaggaggtcctcacggagaacaaggaacagatccccgtcgactacgtgtcgaccggaaataaccaccatgtcgctatatacgaagacgaggacgggaatctccaggagaaggtcgtaagtttctacgaagccgtgatccgagtcaacgaaggtctcccaatcatagacaaagaatataacaagtcacttggctggacgtttaaattcaccatgaaacagaacgaaatgtttgtcttcccctccgaggacttcaacccaaccgagatcgacctcctcgatcagaagaacgcctccctcatatctccaaaccttttccgtgtccaaaaattcacaattaaggactacttctttcgccaccacctggagaccaccgtcgagaacaacaataccctcaagaacactacctggaggcgcgagggcctctccggtatctatggaataataaaaatccgactgaaccacctaggcgagatcgtgcaggtaggagagtactga

SEQ ID NO: 6761 - RNA, 4194 nt, synthetic construct
  misc_feature 1..4194: note = Cas9 variant
  source 1..4194: mol_type = other RNA
atgaacgaaaataaagagtggttcctcgggctagacatcggcaccgcgtcagtaggatgggcagcaaccgacacgaactacaacctactcaagctaaaagggaagaagtcgtggggagtgcgcctattcgacgaggctcaaacggccaaagaacgcagggactgcagatccaagcgccgccgactggcgcggagaaaatggcggctgggcctattggaggaactcttcgccgaggaaataaacaaaatagaccccaacttctttatgcggctccgcgagtcgaaatacaaggtcagcgacaaaaccggcaacgttcccagcatactcttcaatgaaaagaactacaccgacaaagaatactaccgcaattacaaaacgatctaccacctacgagccgaccttatacacaaaaacaaccccgacatacgcgagcttttcctcgcaattcaccatatactcaagtatcgcggacatttcctcttcgccgggcagcagttcaagggctcagaaatcaaggacaacatacgagaactcctacaatacaacagcctcaacatcaagattgacataaccgatgaactgataaacaacatagcggaaatccttctcaagaagaaaaacagcaccgacaaaatcatagagttcaagaaactcttcgcggacgaaaaacaacttatcgaggccctccgactagccctcgggaacaaaacccagctcgcaaaactgttcgacatcgaagcgtacaaagagctagacatcagcatcaaaaccatctcgttcaaagagaaaatctacgaagacgtacgcagcaactatgaagaaattctcggcgaatacattatcgtactggacacagcaaaacttatctacgacgcgatcatcctctctaaaataaagatcaaaaacatgaccataagcgaatccaaggtcgtctcatacgagaaacacggcaaagatctaaaacagctcaaacaccttatcaaggaggactgcaaactgagcaaaaaggagaagcgacagctattcgaaaacatcttcgtgaaggaagacgagaaaggcgctaactatgtcaactacataggcaaaaacaacgccggatcctccaaatcttcatgctcgtatgaggacttcaagaaattcctcaccaaggagctcaagtgctgtgaggagagcaaacttaaacaagacatcctggcagagctggaattggagacattcttgccccgccaacggacaaaggacaacagcgtaatcctctaccagatccacaaagaagagttagaaaagatcctcaacaacgcagtccaataccaccccttcttaaacaacacggatgaatacggaatttctataaaggaaaagatcatacaactcttagagttccgcatcccgtattatgttggaccgctaaacacctcgcacaaagtgggagacggcggcttctcttggtccgtccggaacaaaggttacgaacatatcgcggtaacgccatggaatttcaacaaggtcataaacaaggaagagtcagccaagaacttcatcgagaatctgactaaccagtgcacgtacctactttacgaggacgtcctgcccaaacactccctcttgtactcagaatttgcactactcaacgaattaaactcgattaactacggagggaaacggctaacggtcgaacatagaaacctcataatcgaacgcttcttcaaacaatccgcccctaaggccaccggaaaagagctaaagaaatttcttatgtccgaaggagtaatcgacggcaaagacgagctatcgggtttcgacgtgagcatcaaaaacgacctcaaatcataccgcgacttcaagaaaatactcggggacaaattcgactcagagaaagtcgagaaaatgatccggtggataacactattcggcgaatccaaacagcttctagtcgacaaaataaccaaggaatacggagacatctactccctcgaagaaatcaagaaaatatcgggactaacctacaaagattggggtcgcctctccgaaaaactcctcacagagatcgtgagttcacagctatacgacgagtccaccggagaatgcttcaacatcattaacgcgatgcgcaacaacaccctgctgttcatggaactcctgggaaccaactacgactacttcgagaaaataaacatctataaccgccgattgagaaaagaaataaccgagataacaccgcacatccttgacgacctgtacgtatcacccgccgtaaaacgctccatctggcaagtcgtccgcatcgttgaggaactaaagaaaatcataggttcggaaccaaaacgcatattcgtagagacgaccaggtcgaacaaagaaaagaaaggcgacgacggccggaaagacagcagaaagaaagccctactagaactctacaagaaaatcaaaaccagcgacatcgtcgaacttgagaaagccctcggtcacacagtagacttcgacaaaaagaaacaggacctaaccgacatcgacaataacaaactcaaagctagaaagctctacctctactacacccaattaggtagatgcctatacaccgggaaagcaatcgaccttaacaacctgctctcctccaactcggaatacgacgtcgaccacatataccctcagagcaagaccaaagacggctcctggaacaacctcgtacttgtgaacaagaccgaaaacagcaaaaagtccaatgggctcatctcagagtccatccagcgaaagaacaagcacttctggcgtttcctcaaagctaaaaacctcatcagcgaagaaaagtacaagcgcctaacccgcaccgaggacttcacagacgatgagctatcgggattcatcgctcgccaactcatagaaacctcccaatccgttaaagcagtgtctcagatactacaaaatctcaacccaaccaccgaaatctgtttttcgaaggcagagaacgtccatgattttcgacaagaatttggcaaaataaaggtcggcaaacgacgcaacctgacagaggaacagcaaaaagaagccaaagagggccaactaataaaggtccgcgacctcaacgacctgcaccacgcgaaagacgcatacctgaacatcgtggtaggaaacgtttatcacataaaattcactcggaacccaaagaactttatacggaaaaacagcaaaaaccgcgaatacaccctaaacaccctattctacagcgacaaaatcgagagaaacggcgaagtcgcctgggaaaagggcaagacggagaaaatcgtatccagtgtcatgtgcaacaacctgataaacgtcaccagaagaaccagcgaacaaaagggcgcgctttacgacgcaacaatttacaaagccaacgccgcgaaggaaggctcctactaccccgtgaaaaccaagaacaagaacctgaaagacgtcacccgttacggaggctttacctcgataaaaatcgcctactatagcatctttaaatatgacatacgcaataaagacaaagtcaaagagaatatcaaaataatccccatacccatatatatatcccaaaacatcaaaacagacctagacctgatcaacttcgccgagaagcaaatcaaactgaagaagggtgagaacatcgaaaacctccaactaatctacaagaaacttaacataggtgccctcgtcaaaatcgactactatccctactacgtcgggggcaaaactaacgacaacttctacatcgacggcgccgtgcaagtactcctgtcaagcgacatagaaagatatctcaaagaagtggtgaaattcgtcaacttccaacgagagaacaaagaagcgaaagtatccaaagaacacatctccagcgaagagaacatcgaactctacaacacgctactgtgcaaaatgacggccaagatttttacccacaccaaaaacaataagtacaacgacctagcgcaggacaaggccaaaaacactttcaagaacttgtccttagaagaacaatgcaaagtgctactcgagatcctcaatctcctcacaaataagaagaccacattcgacctctccctgataaatgaaaaagccagccgcgtaaaatgcggcttcaacctactcaaccagaaacaattctcgataatcgaacaatcagttaccggactatacgagaaggaaatcaagataatcgaagattga

SEQ ID NO: 6762 - RNA, 4197 nt, synthetic construct
  misc_feature 1..4197: note = Cas9 variant
  source 1..4197: mol_type = other RNA
atggagacacaagcgtcgaaccagctcatatctagccaccttaagggctatccaatcaaagattacttcgtaggactagacatcggcacatctagcgtgggatgggcagtgacaaataaggcctacgagttacttaagttccgaagccacaagatgtggggcagtcgcctcttcgatgagggcgagtcagccgtcgcccgacgaggcttcagaagcatgagaagacggctcgaaaggcgtaaactccgcctcaaactactagaagaactcttcgccgatgcaatggcgcaagtagaccccaccttcttcatgcgcctccgagagagcaaataccactacgaggacaagaccaccggccacagcagtaaacacatcctcttcatagataagaattacaacgaccaagactatttcaaagaatacccaaccgtctaccatctcagatctgagctcatgaaatctgggaccgacgacataagaaaactcttcctcgcagtccatcatatactaaaataccgaggcaatttcctgtatgagggagccacctttgactcgaacgcatccactctagacgacgtcataaaacaagcactcgaaaatatcaccttcaactgcttcgactgcaactccgcaatatcgtcgatcggacagatcctcatggaagcaggcaagaccaagagcgacaaagccaaggcgatcgaacatttagtagacacctatatcgcaactgacaccgtggacacatccagtaaaacgcagaaagaccaagtaaaagaagacaagaaacgattaaaagccttcgccaaccttgtcctcggcctgaacgctagcttgatcgacctcttcggctcagtagaggagctggaagaggacctcaagaaacttcagataacaggtgacacctatgacgacaaacgggacgaactagctaaagcatggtcagacgagatctacataatcgacgactgtaaatcagtgtatgacgcaatcatcctgctatcaatcaaagagccaggactgacaatatccgagtcgaaggtaaaagcattcaacaagcacaaagacgacctcgccatcctcaaatccctcctaaaatccgacagatccatatacaacacaatgttcaaggtcgacgaaaagggcctccacaactacgtccactatatcaagcagggccgaacagaagagacgtcatgcaaccgagaggacttctacaaatacaccaaaaagatcgtcgaaggcctctccgactccaaagacaaggaatacattctttcgcaaatcgagctgcaaatcctactcccgctgcagcggatcaaagacaatggggtaatcccctaccaactccacttagaagaactaaaggccattctagcgaagtgcgggcccaaattccccttcctaaacgaagtagccgacggcttcagcgtcgcggaaaaactgataaaaatgctagagttccgaatcccgtactatgtcggacccctaaacacacaccataacgtcgacaacggagggttcgcctgggccgttcggaaagcctccgggcgcgtgaccccttggaacttcgacgacaagatcgaccgtgaaaaatccgctgccgccttcatcaagaatctgacaaacaaatgtacctacctcctcggcgaagacgtgctcccaaaatcatcactactctactccgagttcatgttactaaacgaactaaacaacgtccgcatcgacggaaaacccttggaaaaggtagtaaaagagcacctaatcgaagccgtcttcaagcaagaccataagaaaatgactaaaaaccggatcgagcagttcctaaaagacaacggatatataagcgaaacccacaaacacgaaatcacaggcctcgatggcgagatcaagaacgacctcgcatcctacagagacatggttcgaatcctcggagatggattcgatcgctcaatggcggaggagatcattaccgatatcaccatattcggcgagtcgaagaaaatgcttcgggagacactacgaaagaaattcgcatcctgcctagacgatgaagccataaagaaactcacaaaattgagataccgagactggggccgattgagccaaaaactcctaaacggtatcgagggatgcgataaagcgggagacggcacccccgagacaatcatcatcctcatgcgaaacttctcatacaacttaatggagctgctcggcgacaagtttagcttcatggaacgcatccaagaaatcaacgcgaaactaaccgaaggacaaatcgtaaaccctcacgatatcatcgatgacctcgcgctaagcccggccgtcaagcgcgcagtatggcaggccctaaggatcgtggacgaggtcgcgcacatcaaaaaggctctcccggcgcgaatctttgtggaagtcacaagatccaacaaaaatgaaaagaagaagaaagatagccgtcagaaacggctctcagatctttacgcagcaataaagaaagacgacgtgctactaaacggcctcaacaacgaaatattcggcgagcttaaatcatcattagcaaaatatgatgacgccgccctcagatcaaagaaactgtacctatactacacccagatgggccgatgtgcctatacaggggaaataatcgagctctccctcctgaacacggacaactacgacatcgatcacatatacccccgatctctaacgaaagacgactcctttgacaaccttgtactgtgcaaaagaacagctaacgcccagaaaagcgacgcatacccgatatccgaagaaatccagaaaacacaaaaacccttctggaccttccttaaacaacaaggattgataagcgaacgaaaatacgaacggctaaccaggataacgcccctcacggcggacgacctgtccggcttcatcgctcgccagctcgtagaaacaaaccagagcgtaaaagcagccacgaccctactgcgacgcctgtacccaggcgtcgacgtagtcttcgtcaaagcagagaacgtgaccgacttcagacatgacaacaacttcatcaaagtaagatccttgaaccatcaccaccacgccaaagatgcatacctgaacatcgttgtcggaaacgtgtaccacgagcgcttcacccgcaactttcgcgcctttttcaagaaaaacggagcaaaccgcacctataacctcgcaaaaatgttcaactatgacgtcaactgcacgaacgcgaaagacgggaaagcctgggacgttaaaaccagcatggataccgtgaagaaaatgatggactcaaatgacgttcgcgtgacaaagcgactcctagagcaaaccggagcactagccgacgcaaccatatataaagcaacagtcgctggcaaagcaaaagacggagcatacatcgggatgaaaaccaagtcaagcgtcttcgccgacgtaagcaaatacgggggaatgaccaaaatcaaaaacgcctacagcataatcgtgcaatacaccggcaaaaagggagaggtcataaaagaaatcgtcccgctacccatctacttaacaaaccgcaacacgacggaccaggacctaatcaactacgtagcatcgatcatcccccaagccaaagacatctcaatcatctacggaaagctatgcatcaatcaactcgtaaaagtaaacggtttctactactacctgggcggtaaaactaactcaaaattctgcatcgacaacgcgatacaagtgatagtgtcaaacgaatggatcccgtacctgaaagtgctcgaaaaattcaacaacatgcggaaagacaacaaagacctgaaagcaaacgttgtatccactagagccctcgacaacaaacataccatagaagtccgcatagttgaagagaaaaatatagagttcttcgactacctcgtttcaaagttgaaaatgcccatctaccagaaaatgaaaggcaataaagcagccgaactatccgaaaaaggatacggactcttcaagaaaatgtcgctggaagaacaatcaatccacctgatcgagctgttgaacctactaaccaaccagaaaactaccttcgaagtgaaaccactcggaatcactgcctcacgatcaaccgtcggatctaaaattagcaaccaagacgagttcaaggttataaacgagagcattactggactatactcaaacgaagttaccatcgtctga

SEQ ID NO: 6763 - RNA, 4197 nt, synthetic construct
  misc_feature 1..4197: note = Cas9 variant
  source 1..4197: mol_type = other RNA
atggagaaaagctactctatagggttggatataggcacaaacagcgtaggctggtccgtaatcaccgatgattacaaggtccccgcaaagaaaatgcgggtactcggcaacacagacaaaaagtacattaagaaaaacctccttggggccctcctgttcgattccggcgaaaccgccgaagcaacccgtttaaagcgaactgcccgacggcgatacacccgccgcaaaaaccgactccgctacctccaagaaatattcgcaaaagaaatggcaaaagtagacgagagcttcttccaacgtctcgacgaaagtttcttgacagacgacgataagaccttcgactcacacccgatcttcggcaacaaggcagaagaagacgcctaccaccaaaaattcccgaccatataccatctacgcaaacatctcgccgactcccaggaaaaagccgacctacgcctcatctatctcgcattggcacacatgatcaaattcagaggacatttcctatacgacaactttaatgacgacaacttcgactggcgcaacatcgacatccaaaaacgttacgaagagtttatagagacttacgacagcacgctcggcgagtcctaccttgccgatatatctgtggacgcagcgtcaatattagaggaaaaagtgagtaagaccgaacgactcgagaaccttcttaaatactatcccaccgagaagaaaacgaccttcttcggtaatctcataaaactcatacttggacaacaagcaaagttcaaagcaatcttcaacctagaggacgaaatcagcctgcaatttgccacccccacatacgacgaggacttagaggagctcctcggcaaaatcgacaacggcgactcatactcagaactcttcgtagccgcacaaaacctttataacaccatcctcctggcatcgttccttaaaaccgacaacaaatccgccaaagcgccattgtcaaccagcatgatcgagcgatacgagaaccacaagaaagatctggctaaactaaaagactttgtcaaaaagaactgcccagaccaataccatgacatattcagggacaaaagcaaaaacggatacgcgggttatatagacaacggcgtatcacaaaatgacttctacaccttcatagggaaatgcctagaagagtcgctgaaaaaggacaagggcgcccagtacttcctcgacaaaatcgaccgggacgacttccttcgcaagcagcgaactttcgataacggcgcgtttccctaccagatccatctccaggaaatgcacgcaatactgagacggcaaggcgattactaccctttcctaaaggaaaaccaagacaagatcgagaagatcctaacctttcggatcccctactacgtgggccccctagccagaaaggactcgcgcttcgcctgggcaaactaccggagcgacgaggccatcaccccatggaacttcgacgaggtcgtggacaaagaaaaatcagcggagaaattcattacccgcatgaccctcaacgacttatacttgcccgaagaaaaagtccttccaaaacatagcctaatatacgaaacattcaccgtttacaacgaactgacgaacatcaagtacgtcaacgatcagggcaacgcaatccacttcgactccgaactcaaggagaagatctttaaccaactgttcaaagaaaaccgcaaggtaagcaagaaaacacttatcgacttcctcaataactccgaaggaatctataccgacaaactcgtaggcattgacgaagaagtgaaatacctaaacgcgtccctcgggacctaccacgacctcaagaagatcctcgagagtttcatggatgacgagatcaacgagaaaatcatcgaggacatcatccaaacattgacgctattcgaagacatcgaaatgaagcgacaacggcttcaaaaatatgacgacatattcacacctaagcagctgaaagagctcgcgagacgcaactataccggctggggccgcctatcctacaagttaataaacgggatccgaaataaagagaacaataagacaatcctcgactacctgaagaatggcaatagaaatttcatgcagctgataaacgacgatcgcctaagtttcaaacagatcatcatagacgcacgcaagatcgagaaactcgacaacatcgagtcagtcgtctacaacctacccggatctcccgccatcaagaaaggaatactacaatcgattaaaatcgtagatgagctggtcaaagtaatgggccacaaccccgacaacatcgtcatcgaaatggcgagagagaatcaaaccaccaatcaaggcaaaaaccggtcccaacaaagattaaaacgcctacaagactcaatgagtaacttcaaggactcctcaatcagcctcaaagacgtagataattccgacctccaaaacgaccgcctattcctttactacatccagaacggcaaagatatgtatactggcgaagaactggatattgaccacctatcggactacgatatagaccacataattccccagagcttcatcaaggacaacagcatcgacaaccgagtcctaacgtccagcgccaagaaccgaggaaaaagcgacgacgtcccgggcagagacgtggtcctaaaaatgaagcccttctggaagaaactctacgacgtaaaacttatatctaaacgaaagttcgacaatctaaccaaatctgagcacgggggcctaaccgaaagcgacaaagcaggattcattaaacgtcaacttgtggaaactcggcaaatcacgaaatacgtagcccagatacttgacggccgtttcaacaccaaacgcgacgataacaacaaggtcatccgtgacgtcaaagtcataacccttaagagctccctagtaagccagtttagaaaggacttcggtttctacaaagtccgcgaaatcaacgactaccaccacgcgcacgacgcatacctgaacgccgtagtgggcactgcgatcctcaagaaatacccaaaactagctccggagttcgtctacggtgaatacaaaaagtgcgacgtccgcaaacttatcgcaaagtcgggcgacaaatccgagatcggaaaagctactgcaaagtactttttctatagtaatctcatgaacttcttcaaacgcgtaatcagatatagcaacggcatgatcgtggtccggcccgtgatagagtacagcaaagacaccggagaaattgcctgggacaaagaaaaggacttcaagacggtatgcaaagtactgtcctgtccacaggtcaacatagtgaagaaagtggaaaaacaaagccacggtctagaccgaggaaaaccaaaagggttctacaacgcgaacccatctcccaaaccgaagaaaggaagtaaagtgaacctcgtccccatcaaggccaacctcaatcccaaaaattacggaggctacgccggaatctccaacagctacgccgtactcgtggatgctacgatcgaaaagggcgccaaaaagaaactcacgcgaatccaagagttccaaggaatatcaatcatagaccgagaaaaatacgaaaagaacaaagtggagttcctaaaaggcctaggttacaaagaaatctactccatcatcacgctccccaaatacagcctcttcgaactagcagacggctcccggagaatgctcgcgtcaatcctaagtaccaacaacaaacgaggggagatccacaagggcaacgaattagtcttacccgctaaatacatccccctcctctaccacgccaaccgcatccacaacaccttcgagaccggccaccgagaatacgttgaaaaacacatcgcggagttcaaagaaatagcggaaataatcctagagttcaacaacaaatacgtcaacgcaaagaaaaattcctcgatcatcgaaaaagcattggagagcttcgactccttctcgctggacgaaatctgcgactccttcgtcggtaaactcaagaaaaacaacaccaaaaagaacagcggactcttcgagctagtaagcctcggaagcgcatcggacttcgagttcctagaaacaaaggtcccccgttaccgagactatacaccgagctccctactcaacgccaccctcatccatcaaagcatcacaggactttacgaaacccgaatagacctctccaaactcggcgaagaatga

SEQ ID NO: 6764 - RNA, 4197 nt, synthetic construct
  misc_feature 1..4197: note = Cas9 variant
  source 1..4197: mol_type = other RNA
atggaaacacaggcctccaaccaactaataagctcccacttaaagggataccccatcaaggactactttgttggattggacataggtacttcaagtgtcgggtgggcagtaacaaataaagcctacgaactcctaaagtttcgttcgcacaagatgtggggcagccgcctgttcgacgaaggagaatccgccgttgcacgcagagggtttcgctccatgcgccgtcgactagagcgccggaaactacgcctgaaattactagaggaactgttcgccgacgccatggcacaagtggacccaacattcttcatgcgtctccgagaatccaaataccattatgaagacaaaacgacagggcactcgtcgaagcacatcctattcatcgacaaaaattatactgaccaggactactacaaagcatacccgactatataccacctccgcgccgaactgatgaaagacggtacatacgacatccgcaaattattcctagcagtccaccacatcctcaagtacagagggaatttcctgtacgaaggggcgtcatttgactctaacgcctcaacactagacgacgtcctcaagcaggccctcgagaacataacatttaattgcttcgattccagcgccgcaataggaagcatcggacaaatactcatggagaccggcaagacaaagagcgacaaagcgaagacaattgagaggctcgtcgacacatacataattaccgacgaagtaaacgcgagcggcaaaacccaaaaagaccaagtcaaagaagacaagaaacggctcaaggccttcgcaaacctcgttctaggcctaaatgcaagccttattgacctcttcggctctgttgaagaactcgaagaagaccttaaaaagctccaaataacaggggacacctacgatgacaagcgcgacgaactagcaaaggcctggtcggacgaaatctacataatcgacgactgcaagagcgtatacgacgccatcattttactgtcaataaaagaaccaggattaaccatctccgaatctaaggtaaaggccttcaacaaacacaaagacgacctagctatcctcaaatccctgctgaagtctgaccgatctatctacaacgccatgtttaaagttgacgagaaaggactccacaactacgtccactatatcaagcaagggcgaacagaagaaactagctgcaatcgcgaagacttctataagtacacaaagaaagtagtggaaggacttcccgacagcaaggacaaagaatacatcctatccgaaatcgaactccagaccctcctccccctccaaagaatcaaagacaatggagttatcccttaccaactccacctagaagaactcaaggtcatactcgccaaatgcggcccaaagttccccttcctgaacgaagtagccgacggcttctccgtagccgaaaagctcatcaaaatgctagagttccgaataccatactatgttggaccactgaacacctcacacaacgtcgacaacgggggcttcgcctgggctgttcggaaagcctctggacgagtcaccccctggaacttcgacgacaagattgaccgcgaaaaatcagccgccgcctttattaagaacttaaccaacaagtgcacctacctacttggcgaagacgtactaccaaaaagttccctactatattcagaatttatgctcctcaacgagctaaacaacgtccgtatcgacgggaagccactagaaacaaaagtaaaggcccacctcatcaaagcagttttcaaacaagaccacaagaaaatgaccaaaaacagaatagagcaattcctcaaagataacaactatatacccgagaaacacaaaccggaaataaccggcctcgacggcgagatcaagaacgacctcgcctcataccgagacatggtcagaatactgggcaacaactttgacctcagcatggcggaggagataataacggacattaccatcttcggcgaatctaagaaaatgttacgagaaacgctccgcaaaaagttcgcatcctgcctggatgacgaagccatcaagaaactatctaaactaagataccgcgattgggggagactttcaaagaaactcctaaacgggatcgatgggtgcgacaaagccggcgacgggacctcggtgacaattatagaagccatgcgagacttctcctataacctaatggaactactaggagaccgcttcctgttcatggaacgaatccaagagatcaacgacaaactcacggaaggacagatcgtaaacccgcacgacatcatagacgaccttgccctatctcccgcagtaaaacgggcagtatggcaagcactcagaatcgtagacgagatagtccacataaagaaagccctgcccgcccgcatcttcgttgaagtcactcgaagtaacaaagccgagaaaaagaaaaaggattcgcgacaaaaacgactaagcgatctatatgcggccatcaaaaaggacgacgccctcctttcagggctgaccaacgaggagtttggtggactcaagtccgaacttgcaaagtacgacgacgcagcgctccgatctaagaaattatacctatactacacccaaatggggcgctgcgcttatacgggcgaggtcatcgacctatcacaactgaacaccgacaactacgacatcgatcacatctacccccgaagcctcaccaaagacgattcattcgacaaccttgtactctgcaaacgaaccgccaacgcccagaaatcagacacatacccgatatcgaaagaaatacagaaagcgcaaaaggcgttctggatattcctcaagcaacaaggcctaatatccgaaagaaaatacgagcgattgacaagaatcacgccccttaccgccgacgacctatcaggcttcatagctcgtcaacttgtcgaaaccaaccaatcggtcaaagcggcaaccaccctcctccgccgcctataccccgatatcgatgtagtcttcgtcaaagccgagaacgtgaccgatttccgacatgacaacaacttcatcaaggtgcgaagcctgaaccaccaccaccacgctaaggatgcctacctgaacatcgtggtcgggaacgtctatcacgagaaattcaccagaaacttccgcgccttcttcaagaaaaatggtgccaatcgaacctacaacctcgcgaaaatgttcaattatgacgtgaaatgtaccaacgcaaaagacgggaaagcatgggacgtaaaaacctcgatggacactgtaaacaagatgatgacgagcaatgacgtccgggtgacgaaacgcctactcgaacaatcaggcgcactcgccgacgcaaccgtctataaggcgaccgtggccgccaaggccaaagacggcgcatacatcggcatgaagacaaaatcgagcgtcttcgccgacgtaaccaagtacggcggcatgacaaagatcaaaaacgcctactccataatagtacagtacatcggcaagaaaggagaagtcgtgaaagaaatcgtcccccttcccatatacttaacgaaccgcaacatcaccgaccaggacctcatcgactacgtcgcatccataacgccccaagcaaaagacatcagtataatataccgcaaactatgcattaaccagttagtcaaggtgaacggattctactactacctcggaggaaaaacgaactcgaacatctacatagacaacgccgtcgaagtcgtagtgcctgccaacatcgcagtatacataaaagtccttgaaaaattcgcccttttgcacaaagataacaataacataaaagcctccaccgtcaccactcgtatatacaatgaggggagcaccaacatagtctcaatcaccgacaaggacggcctgatcgtctatgattacctaatgtcgaaactacgcacaccactgtacatgaaaatgaaaggcaataaagtagacgagctgagcactgtagggagaagcaaattcatgaacatgacactagaggaacaaagcatatatcttcttgaagtccttaacctactcacaaactccaaaacaacatttgacgtaaaggcattgggcatcacggcctcccgaagcaccattggagtcaaaatacacaccctcgacgagttcaaaataataaaccaatcgatcacaggcctatattcgaacgaaataaccatcgtatga

SEQ ID NO: 6765 - RNA, 4197 nt, synthetic construct
  misc_feature 1..4197: note = Cas9 variant
  source 1..4197: mol_type = other RNA
atggaaacgcaaaccagcaaccaactcataacctctcacctgaaggactacccaaaacaagattacttcgtaggcctcgatatcggcacaaactcagtaggttgggccgtcaccaatacatcctacgaactcctcaaattccacagccacaaaatgtggggaagccgcttattcgaagaaggtgaatcagcagtcacacgaaggggcttccgcagtatgcgacgcagactcgaacggcgcaaactcaggctaaagctcctagaagaactcttcgctgacgcaatggcacaagtcgactcaacattcttcatccgactccacgaaagcaaataccactacgaggataaaactaccggccactcaagcaaacatatcctatttattgacgaggattacacagaccaagactacttcacagaatatccgacaatctatcacctcagaaaagacctgatggaaaatggcaccgacgacatccgcaaactattcctcgctgtccaccatatcctgaaataccgcggaaacttcctatacgaaggtgcgacattcaactccaatgcatttaccttcgaggatgtgcttaagcaagctctcgtgaacataacgtttaactgcttcgataccaactcagcgatcagcagcatatccaacattctcatggagagcgggaagaccaaaagcgataaagcgaaagcaatagaacgactcgtcgacacgtacaccgtattcgacgaagtcaacaccccagacaaaccccagaaggaacaagtcaaagaagacaaaaagacactaaaagccttcgccaacctagtactaggcctctcggccaacctcatcgacctcttcgggtcggtagaggatatcgatgacgacctaaagaaactccagatcgtgggcgacacctacgacgaaaaacgggacgagctcgccaaggtctggggagacgaaatacacattattgatgactgcaagtcagtgtacgatgcaatcatattgatgtccataaaagaacccgggctcacaatcagccaaagcaaagtaaaagcatttgataagcacaaggaggacttagttatactcaaatctctactgaagctagaccgtaacgtttacaacgaaatgttcaagtctgacaaaaaggggttgcacaactacgttcactacattaaacaaggacgaacggaagaaacgtcctgctcacgagaagacttttataagtacaccaaaaagatcgtagagggactagcggacagcaaggacaaagaatacatactcaatgaaatagaactgcagacactactgccgttacaaaggatcaaagacaacggcgtaatcccctatcaactgcatctagaagaactcaaagtaatcctcgacaaatgcggaccaaaattcccctttctacacaccgtctcagacgggttctcggtcacggaaaagctcataaagatgctcgagttcagaataccctactacgtgggccccctgaacacccatcacaacatagacaacgggggcttctcatgggctgtgcgaaagcaagcaggtagagtcaccccatggaacttcgaggaaaagatcgaccgagagaaaagcgcagccgcattcatcaaaaacttaacaaataaatgcacatacctcttcggcgaagacgtgctaccaaaatcatcactcctctactcagagttcatgctactcaacgaactcaacaatgtacgcatagacgggaaagcgctcgcacaaggagtcaaacagcacctaatagacagcatattcaaacaggaccacaaaaagatgaccaaaaacaggatagaactgttcctaaaggacaacaattatatcacaaagaaacacaaaccagaaatcactggcctggacggggaaatcaaaaacgatctcacgtcatacagggatatggtccgtatcctcggcaacaacttcgacgtgtccatggccgaggacatcatcacagacatcaccatctttggggaaagcaaaaagatgctccgccagacactacgaaacaagttcgggtcacagctgaacgacgagacaattaaaaagctaagcaaactacggtaccgagactggggccggttatcgaagaagctcctcaaagggatagacggttgcgacaaggcaggcaacggagccccgaaaaccataatagaactgatgcgaaacgactcatacaatctgatggaaattctgggagacaaattctcatttatggagtgcattgaggaagaaaacgccaaactcgcacaaggtcaagtcgtgaacccacatgacataatagacgaacttgcgctttcacccgctgtcaaacgggcggtttggcaagcactccgtatagtcgacgaagtcgcccacatcaagaaggccctcccctcccggatattcgtcgaggtcgcacgaaccaacaagtcggaaaagaagaagaaagacagccgccagaaaagactatctgatctctacagcgcaataaagaaagacgatgtgctccaaagtggcctccaagataaagagttcggcgccctgaaaagcggcctagcaaactacgacgacgccgccctccgatcaaagaaattatacctctactacacgcagatgggccgctgtgcctatacaggcaacataatcgacctcaaccaactcaacaccgacaactatgacatcgatcacatctacccccgaagcctgaccaaagatgactcgttcgacaaccttgtactctgcgaacgaacggcaaacgccaagaaatctgacatctacccaatcgacaaccgaatccagaccaaacagaaaccattctgggcctttctcaaacaccaaggcctgataagcgaaaggaaatacgaacgccttacccgaatagcgcccctaaccgccgatgaccttagcggcttcatcgcgcggcagctagtcgaaactaaccaaagcgtgaaagccaccaccacactactcagacgcctgtacccggacatagacgttgtgttcgtgaaagctgaaaacgtaagtgacttcagacacaacaacaacttcataaaggtacgctcgctaaaccaccaccaccacgccaaagacgcctacctgaacatagtagtcggcaacgtctatcacgaaaagttcaccagaaattttcgcctgttcttcaagaaaaacggggcaaaccgcacatacaacctcgctaaaatgttcaactacgacgtcatctgcaccaacgcgcaagacgggaaagcgtgggacgttaagacgtccatgaacaccgtaaagaagatgatggccagcaatgatgtccgcgttacacgtcgcctgctagagcaaagcggagccctcgccgacgccaccatctacaaagcgtccgtagccgctaaagcgaaagatggcgcatacataggcatgaaaacaaaatacagcgttttcgcagatgtcaccaagtacggtggaatgacaaagatcaagaacgcctacagcatcatcgtccaatacaccgggaaaaagggcgaagaaatcaaagagatcgtacccctccccatatatctaatcaaccgcaacgctacagacatcgaactaatcgactacgtgaaatctgttatccctaaggctaaagacatttcgatcaaatacagaaaactgtgcattaaccagctcgtcaaggtaaacggcttctactattacttaggcggaaaaaccaacgacaaaatatacatcgataatgccattgagctagtggtcccccacgacatcgccacctacataaaactgctcgacaaatacgacctcctcaggaaagaaaacaaaaccctgaaagccagcagcattactacctcaatctacaatataaacacctccaccgtggtaagcctctccaacaaagtcgggatcgatgttttcgactatttcatgagcaaacttcgcacacccctctacatgaagatgaagggcaacaaagttgacgaactctcaagtacaggccgatcgaagttcatcaaaatgacgctcgaagaacagtcaatttatctcctcgaggtcctcaacctgttgactaactccaaaacaacgtttgacgtcaaacccctaggaatcaccggctcacgctcaaccatcggcgtcaaaatacacaatctagatgagttcaagataatcaacgaatccatcacaggactctacagcaatgaggtaacgatcgtatga

SEQ ID NO: 6766 - RNA, 4200 nt, synthetic construct
  misc_feature 1..4200: note = Cas9 variant
  source 1..4200: mol_type = other RNA
atgaagaccatattaggactagacctaggcaccacctcgatcggatgggccttagtcaaggaagccgaaccgttcagcgacgagaaaagtgaaattgtgcggttaggagtccgcgtcatcccgctcacggtcgacgaacgaacatcgttcgaaaatggaaagagcataacaaccaacgcccttagaacccaaaagcgaggcatgcgccgaaaccttcaaagatacaaactccggagacaagcgctcatcgaggaactcaaatccaccggatggataggcaacgactttatattcagcgaaaccggaccagggagcacattccggacactccgactccgcgcaaaaagcgctagtgaagaagtcacactgggcgacctagcccggattctgctccaaataaataaaaagcgcggctacaaatcctcccgaaaaatggtcagctccgacgacgggcaagcaatcgacgggatggccgtcgcgaaagaaatgtacgacaagggcctcacgccaggcgagtacgtctatcagcggatgctcgaaggcaaatacgcaatacccgagttctataagagtgacctgcaagaagagttcgaccgaatatgggcgctccagaagtcatttcacatagaactaaccgacgaactgtaccgcaaactgagtgaccggaacaagtcccaaacgtgggccatctgcagagacgaactaggcatccagggcctaaaaagctcattcataggtaaggaacgtttaaaagaagcctaccgataccgtcacctcgcggcgacacaagaagtcaacatggaggtactcacgtgcgcgctacaagagatcaacggacaaaaggccagcctgagcggccttctctccaaaatatcagaccgaagcaaagaactctacctcaacaaccttaccgtgggtcaaatgctcctcaaacgcatagaggacaaccccaataattcactcaagaatatcgtattctaccgccaggactatttggacgagttcgagaggatctggacagtgcaaagcaaataccacaccgagcttacacatgaactaaagaaacgcctacgggacataatcatcttctaccaacgccccctgaaaagccaaaaagggctaatctccctatgcgaactagagaccaaagacatcgaagtagcgattgacggagtaaagaaaatgaagaacatagggccaagagtctgcccgcgatcaagccccctcttccaagagttcaaaatatggcaaactatcaacaacattttcgtgaacggcgcggcgctcgacgacgaagacaaatctgtaatagccaaagaacttatgttcaaagacaaactcaaggatagcgacctcctcaaactgctgttcaaaaccacgaaaggtcaatcggtaaacttcaaagaggtagacggaaaccgcaccatggcgacgctaatgaaggcatgcttcaaaatagcagaaaacctaggctacgacgacatcggtctcagcaaacttagcagcgaggaccagatggtcaggattgaaggaatcttcaaagaacaggggttcaagaccggcttcttacacttcgacagcagcctagcctctccggagttcgaaaaccaagacagctacaggctatggcatctgctatatagctacgaaggcgacaaaagcgcgtccgggaacgaaagcctggtcaagtgcataatggacctctgtagcatggatgagggaagtgcgaaaatattagcgtcctgtacattccttccggactacggatcactgtctgccaaagccatgcgaaaaatcctcccttacatgaaagacgggctggaatataccgctgcctgcgccatggccggatacagacacagcaagcgcagtctgaccaaagaggagctagacaccaaagaatacagcgaccgccttagcctactgcccaaaaacagtctccgcaacccagtagtagagaaaatactaaaccagatgatcaacgtggtcaacagcgtaatcgacgtctacgggaaaccggacgaaataagaatcgagatggcgagagaacttaagaaaagcgccaaagaacgcgaggaagcccaaagggatatcgcctcctcaaccgcggagagccagaaggtaatagaaatactaaagggcgaacccttctttcttcagtttcccacccgcaacgacataatcagataccggctctaccaagagctggcacaaaacggcttcaagaccctatacagcaacacatatatcccaaaggacaaactcttcagcaaagagttcgacatagaacacataattccacaagccctcatcttcaacgacagcttcgcaaacaagacgctcgagtcacgccaatgtaacttagaaaagggaaaggagacagcaatggactatgtcaagagcaaatacgacgaaaccggagtacaaacctactgcgacagagtgaacggcctcatcggcaagggcatatcaaaaacaaaagcaaaatggctgctaatggaaggaaaagacatccccgaagatttcataaaccgagaacttcgggactcacaatacatcgcaaagaaagcacgagaaattctagaaagcctagtaaaattcgtagtcccgaccaccggctcagtaaccgccagactccgcgaggactggcagcttgtaaatgttatgcaagaacttaactgggagaagtatgcgcgtctcggcctcactggagtccgagaggacaaggatgggcgccgcatccccttcatacaggactggaccaaaagaaatgaccaccgccaccacgcgatggacgcgctaacaatagcgttcacacgcagacaatttatacaatacctcaaccacctcaacagcaaaattgacgtagtgagctgggacaagaaagacctggacctacgagattacgaccttgaagacattaaattcggcaacctctccgctggagacagatacggcatagtcaaagccctgcaagacaaatttctctacaaagacggaaacgacaaataccgattcgtcccgccgatacccctcgacgagttccgaagacaggctaaagagcaactaagtgatattctcatcagcttcaaagccaaaaacaaagtatgtacgagaaacgtgaacgtcaccaaaaacaagggcggcgccaacagaaaggcgcagctcacaccgagagggccactccacaacgaaacgatctacggaagcagcctcgaatacgtgacaaaagaaaatgagaagattggctcgtcgttcgatacagaacgaataaccaccgtatgcaaaaagaaattccgagatgccctggctcggcgcctagaggagtttggcggggaccccaagaaagcattcacggggaaaaactcacccgagaaaaacccaatatgggttgacgagcaccactcagaacaagtcccagccaaagtacgcacggttaccatgggacaacgattcaccggacgcaaaccaatcgacgcaacgctgaaaatagaaaaagtgatagataaacgcatacgtgaaatactacaagcccgactggacgagttcgacggtaaagcagcaaaggcattctcaaatctcgacgagaaccccatttggttaaacaaagaaaaagggatcgcaattaaacgcgtcaccgtgtccggccccgcgaacccagtaccggtaaggttcaagcgagacaaagacgggaaacccatcattgatgacgccgggaaaaccataggagcggacttcgtaaccccaggaaacaaccaccacatagccatatttcgcgacagtagcggaaagctgcaggaacatcccgtatcattcctggaagcaactatagcaaaatctcacggcctagatgtcatagatcggaactacaacaaggacgaggggtgggagttccttttcacactcaaacagaacgaatactttgtattcccgaactccgaaacggggtttaacccgctcgactacgacctaacagacccacgaaactacgccgagatcagccccaacctctaccgtgtacagagcatatctaccaacgactacttctttaggcaccacctagagacaacctcagagaaaaacaattccctatacggcatcacctggaaacgcatccgaaacgccagcgcgcttgaaggcctcgtcaaggtccgaatagacaatttgggccggatagtcgcggtcggcgagtacgactga

SEQ ID NO: 6767 - RNA, 4200 nt, synthetic construct
  misc_feature 1..4200: note = Cas9 variant
  source 1..4200: mol_type = other RNA
atggaaacacaagccaccgcccaactcatctctggacacctaaaaggatacccaatctacgactacttcgtgggcctagatatcggcaccaattctgttggctgggccgttacaaacagaatctatgaactactcaagttccgcagccacaagatgtggggatcacggctctttgaagaagggcagaccgcagtcgtccgccgaggattcaggtcaattcggcgcagactggagcggcgaagactgcgcctgaaacttcttgaagctctcttcgcggacgctatggcccgcgttgactcaacattcttcatccgactccgggaatcgaagtaccactacgaggacaaaaccacgggacacaaatcgaaacatatcttgttcatcgacgacaactacacggaccaggattacttcgccgagtacccgacaatataccatctccgagcggacctaatggagaacggcacttctgacatccgaaaactattcctagccgtccaccacatactgaaataccgcgggaactttttatacgagggcgcgacgttcgactctaattcatccttagacaccgtgctaaagagagccttggagcaaatcgagttccacatcttcaacgccacctccgaggacgcactgcatagtatactggacatcgtgaagctgcaggacaagactaaatctgacaaagcaaaagcgatcgagtccctagtggacacctacataacggacaaagtcgaatcatcctgcacggacaaagagaaaaaggacctgcttaaggccgataaaaagaggctccgcgcattcgccaaccttatcttgggactcaacgcgaaccttaccgacctattcggcacgatagaagagatagaggaagacttcgtcaaactgcaaatcaccggggacacctacgaggaaaaacgagacgactacgcgaaggtctggggcgacacaatacgaatcatcgacgactgcaaatccgtatacgactccataatactcatgtcaatcaaggaaccaggcctcaccatcagccaaagtaaggtaaaggcgtttaataaacacaaagaagacctagcgatcctcaaacggttactcaaatccgacaagtacatctacaagaacatgtttaaggcagacgaaaaagggctagcaaactacgtacactatatcaagcaaggaagaaagaacgagaccggatgctcctgcgaggatttttacaaatacaccaaaaaggtcgttgagagcctacctgactctagtgacaaggcatacattctcaacgaaatcgaactccaaaaacttctgcccctacaacggatcaaggacaacggggtcatcccgtaccagcttcacctggaagaactgaaagcaatcctagagaaatgcaaagacaccttcccctttctcaacacagtctccgacggcttcaccgtcgccgagaagctgatcaagatgctagagttccgtatcccctattacgtcggtccattaaaccccagccactcaatcgataaaggcggcttcgcctgggtcgaacgcaaggagcctggccaagtcacaccatggaacttcgaagacaagatagaccgcgaaaaatcagcagaagcattcattaaaaacctcaccaacaaatgcacctatctcataggcgaggacgtccttcccaaatcatccctcttatattcagagttcatgctacttaacgaactaaacaacctccgcatcgacggcaagccgctagaacaagcggtcaaaatgcatctaatcgacgcagtcttcaagaaagaacataagaaacaaaccaagaaccgcataatagagttcctaaaagacaacaattacatacttggtaagcacaaaccagaagtggatgggctagacgaatcaatcaaaggcgacctcgccagctaccgagacatgaaaagaatcctcggcgacgacttcgacgtgagcatggccgaatccataatcacgtctatcacgattttcggggaaagtaaaaatatgctaagggaaacactccgcaaaaagttcggcagcatcctcagcgaagaccaaatacgctcactcgccaaactgcgctaccgcgactgggggaggctgagcaagaaattcctcataggaatcgacggatgtgtaaaaggcgaagacggcacgcccgggacaatcatagacatgatgagaaatacatcgcacaacctgatggaactccttggcgacacgttcagctttatggacgtcattatagaagaaaacgacaaattgacgaaaggacaggtagtagacccacacgaaatcatcgaggaactaggcctcagtcccgcggtgaagcgggccgtttggcaagcgttaagaattgtggacgaagttattcacataaagaaagcactccccagcagaatcttcgtggaagtcgccaggacgaataaggacgaaaagaaaaagaaagactcacgaaagaaaagactgcaagaactatataaatcgatacagaaagaatcgcccgagtggctatcggtcacgagagacgaatcagacaagctcattagcaacctcgaccgcgccgacgacagcagcctccgctccaagaaactctacctctactacacacaaatgggacgatgtatgtacagcggtagagtcatagacctggaccaactcaacaccgataaatatgacatcgaccacatctacccgcgtagcttaaccaaagacgactcattcgataacctcgtactctgcgagcgccaggagaatgccaaaaagagcgacaactaccccattgaccccgacatacaaaacgcgcgcaaaccattttggaccttcctaaaagaccaaaacctgatatccagccgcaaatacgaacggctaacacgcgttctccccctcgaggctgacgacttaacaggattcatagcgcggcaattagtagaaacaaaccagagtgtaaaagcagtcaccactctcctccgaagactctaccccggggtcgacgtcgtcttcgtcaaagctgagaacgtaacggacttccggcacgacaacgacttcataaaagtgcgcagcctaaaccaccaccaccacgcaaaagatgcgtaccttaacatagtcgtaggtaacgtctaccacgaaaaattcacgcgaaatttccgaaagtttctaaagaaaaacggcgccaaacgcacctacaatttagcacgcatgttcgacttcgacgtgatgtcaacgaacgcgaaagatggaaaagcatgggacattaagacgtcaatgaacatagtgaagaagatgatggcctcgaacgacgtcagggtcacaaaaagactaatggaacaaaaaggtgccctatccgacgcgaccgtctacaaggcatccgtagccggcaaagcgaaaggaggagcatatataggaatgaagacaaaggactccgtcttctctgacgtctccaaatacggaggccgcacttcaataaagaacgcatactcaatagtagtagagtacacgggcaagaaaaacgagataatcaaagaaatcgtacccctgcctgtatacctgatcaaccgaaacaaaacggatcaagaactaattcactacatcgtatcaataatcccgcaagccaaaaacgtgagcatcatctacaagaaactctgcatcaaccaattagtaaaagtaaatggattttactactacctcggaggcaaaaccaacaactacttctggatagacagcgccatccaggtagttatcgcagacgagtggatcccatacctgaaggtactagaaaaattcgacgtcatgaggaagcaaaacaaggagctcaaggtcggaacggtctccaccagcatccaaaatcagggcaagaaagtcgtaatcaaaatcctcgaagagagaaacgtggagttcttcagttaccttgtaggcaaactacactcaagcatatacagcaaaatgaagggaaacaaggcgggagaactggcaaccaaaagcctcgaaatattcgtcaatatgtcactcgaaaaccagtgcatttacctaatggaactcctgaatctcctcacaaacaagaaagcaccagacgtcaaaccactcggcatcaccgcaagccgaggcaccatcgggagcaaagtctccaaccaagacgagttcaaaatcataaacgaatcaatcacgggcctgtatagcaacgaggtgaccatcgtatga

SEQ ID NO: 6768 - RNA, 4200 nt, synthetic construct
  misc_feature 1..4200: note = Cas9 variant
  source 1..4200: mol_type = other RNA
atgaacctccgtaacacaaccgacgagtacaacatcggactggacatgggcacaaacagcgtaggatgggccgtgactgacaaggcgggcgccatagcccacttcaagggaaaaccaaccctagggtcccgtctcttcgacgcggcccaaaccgcggcgggcgcccggatacaccggagccagcgtcgaagatacgtaaggcgtcgatggcgactggacctactgcaaagcctcttccaggacgaagtcagtaaggtagactccgagttcttctgccgcctccgccaatcacgcttatacgtcggcgacagggaaaaaggacacgccgactacacctggccaatattcaacgatagcgacttcaacgaagtagactactacaaacgcttccctacaatataccatctgcgaaaatggctgatggaaacagacgaaaaagccgacatacggctaatatacctagcaacccacaacatagtaaagcaccgcggaaacttcctacgcgaaaacaataagagcctcagcagccgggacgctaacccggcacaagccgtcaagagcctccgactggcactcaacgactggtgctccgaacgtgactacgaatgcgcatggaaaggcgaggaggacgatggtgcaatagacgaagcgatcctaaacgtactcgctgatggggagaaaggccggagcgaccaagcaaaagaaatcgccaagctaacaggagtcgattgcggtgacgcgaagcagagcaaacaatgcaacgaagcaatcgccaaagcaatagtaggactcaaagtcgaaatgaagaacatcttcggagagttcccagcagaaaagaccagttacatatacctctcctcagacgaagacgtagaagcggtgcgcgagtcctgtcctgacgactccggggaactatttcaggccctctgtaaactctacagcgcatacatattgcaggagctcctatcctacgcagacccatccggccaaaccatctcggcaaacatggtagccaaatacaaacaatatggacgcgatctccgtcttctgaaagagctcacccgcacttatgccccacaaaaatacgacctgttcttcaggggcgagacatacgcggggagctcagattacgtggtcgatgaagcacgcggatatacaagatacaacttgggaacaactaaagctaactacgacgactttcagaaatcagtgaaagaactcttcaaggggactgacgctctacaagacgaaagataccaagaaatgatggtcgccttcggagaacaaaaattcctaagacggctcaaaacgagtgacaacggctccatctactatcagctacacctggaagaactgcataccatccttgaaaaccaaggcaagcattacccatttttgctgtcggaagaagacaaaatagaatcactcgtaagtttccgaataccgtactacgtgggcccgctcacaaggaaaaacgcagccatcggccacgacgggaaggaaagattcgcatggagctccaggaaggacggcatggaacatgcagtaatcacaccgtggaactgggaagagataatcgaccgggacaaatctgcggaggactttattatgaggatgacgggagactgcacatacttgcaaggagagcccgtactgcccaagtgctcacttctatacgaagagttttgtgcactcaacgagttcaacggagcgcattggacagtcgacggagatgacgaaaggagattcgatgcagcccagagagaacggataatgtgtgacctctttcggcggacacgctcagtgacgtacaacaaagtcagcgactggctagaacgcaagtacaacttcacaggggcgcgagtacgaggaggccaaggcgaacacggcttcgagagcaagctcggaagctacatattcttttgcaaagacgtattcaagaccgacgggctggacgaagcggattacaccatgatagaacaaatcatactctggtcaactctcttcgaagacagggacatactaaagcgcaaaatagaggaagcctacgggggcgacagactcaccagcgaacagatcaaggtaatctgcaaaaagagattcaccggatggggccgattatccaagagattgctaaccgacatcaaagtcaatacagataccggcaggaagtctataatggacgtattacgagagggcaatcccaataacggccaacgctcgagaacgatggtgttcatggaggtccttcgggatgaagacctcggcttccaaaaagcaatagacggcttaaacagagactactttagagaacacaacaacggactaatggacgtaaacgacctacccggctcgcccgcaatccgcagaagcatcaatcaggccgtccgaatcgtcgacgagatcgcctcaatagcgcgcaaagagccaacgaacatcttcatagaagtcacgagagaggaagacgacccacgaaagaaaggcaaacgcacaaaaagacggtatgacgccatcaagagcgcactggaaaaattcaagaaagacgacccatccctctggaaagaactgtgcgagaaagcccctggagacatggacgaaagactctccctttacttcatgcaacgaggcaaatgcatgtactccggaaggcccatcaaaatcgaagaactccacaccggaaaatacgaagtagaccatatcataccaagatcctacataaaagatgactcattcgaaaacaaggtgctagtctatcgcgaagagaatcagcacaagaccgacgccctcctgatagacagctctataaggcaaaagatgggcgggtactggcgcatgctccacgatgcgaagctagtgggcgataaaaagttccgaaacctatttcgaaaccacatcgacgacaaagcaatgaagggattcgtagcgagacaaatcgtcgagacctcacaaatggtaaaactcgtgcaaaccctcttcgaagcgaggtaccccaatacacgcatcgtcccggtgaaagccggcatcagccacgacctgagagaagccgcgggacttgtaaaatgccgtgaggcgaacgactttcaccacgcacatgacgccttcctagcctgccgaataggcctattcattcaaaagagacacccaagcgtatacgacaatcccatcggactcgcacgaatcatgagggattatgcgagaatgcaagcccgcgagtataagaaaagtcactgtcttgcgcacacacaaggcttcatcgtgaactcgtttttaagcagcggtttcgatgaagaaacgggggagatattcaaagacgactgggacgcgaaagccgaagtcgagggcatccggcgcgtcctaaactgccgacaatgcttcatatcgcggatgccagtagaaggagacacacgctacggcggcagatactggggcgaaaccatatactcgcccaaagggaaacacaaacatgaaattccactcaaacaagggctcgacccaaatctgtacggaggctactccgatctcctatacagctatttcctcatatacgaggcatcagacgtaagtagcggggaacgcgtcctacggttcataggcattccaacatcgatagccgcgcgcatggcaaaccaaaaacgcctcgaggaatacgtaagtcgattagccctgcaggagaatctagagcacgtaaggatggtacgcaagatcatgaagaaacagctgatagaagtagacaactgtcgcctgcttgtcaccgcagccgatgccgttaccaacgccactgaattagccttcagcctcgacgaaatgaaaatcatctcaacctgcgcaaaatgcatcaacggggcggacccctcggcaatcgacaaaatcgggaacgcgcaagactccttcttcgacaacctaaaacggcgagggagcgaccggtgcgccctcctattctcacaactaaaactcgataaactgtctcagaacttttacatgatcagctcagacgacaaaagcaagatcctgatcagcatactagaccgcatccgcgcaaagagcaatagcgtcgacctatcactggtaggcggagcaaaacacgcagcccaaatgaagttcgacttcaacgccaaactcaacaatcccgcatcctccttcgtattaatcgaccagagcgtgaccggcatgttcgaaaggaggacaagaataggcctctga

SEQ ID NO: 6769 - RNA, 4203 nt, synthetic construct
  misc_feature 1..4203: note = Cas9 variant
  source 1..4203: mol_type = other RNA
atgaacctgcgtaacgctaccggcgactatagcataggtctcgacctcggcacgaactcagtgggctgggcggtgaccgatagcaacggcagcatggctcacttcaaaggaaagcccaccctcgggtcacggctattcgatgccgccgagacagccgcgggtgcacgccaacaccgaggacagcgcaggagatacgtcagacgacgctggagattagacctactgcagggacttttccaggatgaggtaaacaaagtagactcagagttcttcattcgcctgagacaaagccgactccacgtggaagaccgcgcagaaggacacgccggctaccgatggcccctattcaacgacacagacttcaccgaaaaagactactacaaacgcttccccacaatctaccatctacgaaaatggctcatggaaacagacgaaaaggcagacatcagactcatataccttgccgcccataatatagtcaaacaccgcggcaacttcctccgagaggacaacaaaaacctcagctcccacaacgcaaaccccgccgaagccgtgcgatcactaagacaagctctagacgactggtgtgcagaacgcggttacgtgtgcgcctggacatccgttgacgacctcgcagaggccgacagccatatcctcgacatcctcactaactccaaagaacgccgagcggaccaagccaaagagctcgcaaaactgttcggagttgactgcggggacaccaaacaatcgaagtcatgcaactccgccttagccaaagcagtggtcggattgaaaaccgaactcaaagacgtcttcggtgaattttgtgccgagaaaactgcaatccacctctcatccgatgacgacgttgaggccatacgggacgcaataccagacgacagcggcgaactattccaagtgttgtgcgcagtatacagcgcatacgtacttcaagaactactcagctacgcacccggacaaacgatatcagctaacatggtagccaaatacgaccaatacggcaaagacctcaaactcctgaaaaacctagcaaggacatacgtatccagagagaactacgatgcattcttcagaggccaaacgtacgaagacagtaatgactacaacgtagataaagcacaaggatataccagatacaatctaggcacaacgaaagcctcctacgacgacttcaagaaatcagtggagaagctattcaaaggcacccaagccgagcaagacaagcgataccaaggaatgatgaaaagattcgccgaagagaaattcctacgaagactgaaaacgtcggataacggcagtatctactaccaactccacctagaggaattaagagcgatcctcaagaatcagggaaaacaccacccgttcctgctggaggaagagaagaaaatcgaatcgctcgtcagcttcagaatcccgtactatgtcggtccactctccagcaaaaacgcctcgctcgaccacaagggcaaacaacgctttgcgtggagtgaacgaaggcccgggatgaaagataccgtaatcacgccctggaactgggaccaaatcatagactgtgaccaatcagcagaaaaattcatactcagaatgacaggagattgcacgtacctccaaggcgagcccgtcctcccgaagtgcagcctactctacgaagaatactgcgtcctgaacgaactcaacggagcccggtggacaatagacggcgacgactggcgacgcttcgacgtagcccaacgcgaggggatactccacgatctcttccgaaagacccgctccgtagcatacaacaaagtggccgactggctagagagagaggagaattgggcgaatgcacacgtacgaggtggacaaggtgaaaactccttcgaatcaaaactcggcagctacatcttcttttgcaaggacgtcttcaaaactgcggccctagacgaagccgactatcccatgatagaacagataatcctatggaacacgcttttcgaagaccgagccatactcaaacgcaaaatagaacaggcgtacggcgaacaccacggaggcaaattgactgacgagcagataaaagtgatttgtaagaaacgattcaccggatggggccggttaagccggaaactgctaacaggaataaaagtagatgccgacactggccgcgtctcaatcatggacgtactcagggaagggaaccccaacgaaggacagcggagccgcacgatggtcctcatggaggtcctcagggatgaagatctcggattccaaaagaaaatcgacgacttcaacaaagcctacttcgcaggacaaggagagggtctcatgtcagttaacgatttacctggatcacccgcaatccgcagatcgataaaccaagcgatccgaatcgtagacgaaatagcgagcatcgcgggaaaagcacctagcaacgtcttcatcgaagtgacgcgcgaagaagacgacccacgaaagaaaggcagacgcacgaatcgtcgctacgaagacattaaaaacgcactcgaaaactttaaaacggaggatcaagagctatggtccgaactcttgggaaaagccccaaatgacctggacgagcgactgtccctatattttatgcaacgcggtaaatgcatgtacagcggccggccgataaaactagaggaactccatacagggaaatacgaagtcgaccacataataccgcgcagctacatcaaagatgacagttttgaaaacaaagtattagtatgccgagaagagaaccagcgaaaaacaaacgaaatgctcatagacccagccataagaagacgcatgggtgattactggcgcatgctgcacaaagccaaactaataggagacaaaaagttcaacaatctgttcatgcgcgaccgaatcgacgacaagactttaaaggggttcgtagcgagacagctagtcgagacctcacagtccgtaaagctagtccaaaccctacttgaagtgcgctaccccaacacaaaaatcgtccccgtgaaggccaacatcagccatgacctgcgcgaagctgctgatctagtgaaatgcagagaagccaacgatttccatcacgctcacgacgcgtaccttgcatgtagggtaggcttgttcatccaaaagagacacccatccgtatacgcaaatcccatcggactatcgcgcgtgatgcgagactacgcccgaaaacaagcaggcgagttcaataaaacacacagcatggcccacaccaaaggattcattgtcaacagcttcatgactagcgaatttgacaaggaaactggggagatcttctgggacgccgaggcagccgtcgaggacatccgccgggtcctcaattaccggcaatgcttcatttctagaatgcccgtcgaggacacaggcgcattctgggaccagaccatatacagtccacgaagcaacaaacgactagaactaccactaaaggacgatctcgacccgaacaaatacgggtcatacagccgcgaacagttcgcgtatttcttcatctacgaagccagagacgccaaaaagagcaaaacggtactccgattcgcacaagtccccgtccgcgtgaccagtgcaatagcccgagactctagcaagttggacgaatacgcgagcggactggcggtgcaggaaggactcgagttcaccaagatcatcaggcgacgaatactaaagaagcagctcctcgaattaaacggagaccgcctagtcataacgggcgcaaaagaggtgcgcaatgccacggagttcgcattcaccctcgaagaaaccgcgcttgtagcgatgtgcagcgaaatagcccgggaaggcgtcccgagcgaaatcgcatcagacgtgcagtcaatctcctcccaactatccgacctattcctcgccctcattgagcgcgggctaaccatcggcgtgagactacatggccaactaaaactcggacagtacctccgccagttcgaggatgccgctctccgcgacaaggcaaaggtcatcatcggaatcatatctatcaccaacggagcaacaaataccctagacctatcatcactcaacggctccaaaaacgtaggacaagttcgaataacccacaacaaactcctcaatgacaaaagcaccagctatgtactaatcgaccagagtgtaacggggatgttcgagagacgaacccgaatcggcctctga

SEQ ID NO: 6770 - RNA, 4203 nt, synthetic construct
  misc_feature 1..4203: note = Cas9 variant
  source 1..4203: mol_type = other RNA
atgaaaaccataaccgaagactacatccttggcctcgacatcggcacaaactcatgcgggtgggccgtcatggataagaaaaaccgactgctacgcctccggggcaagagggcaatcgggtctcacctcttcgaggaaggccactccgcggccgacaggcgcagtttccgaacaacgcgccgccggctaaaacgcagaaaatggcgcctccgcctcctcgaggagttcttcgccgaaccaatggcaaaagtagacccagccttctttgtccgcctccatcaatcctgggtatcaccactagacaaagaccgcaagaaataccacgcaattgtgttcccgaccgctaaagaagaccacgagttctaccacgattacccaacaatatatcacctcagagacgccctgatgcgagaagacaggcagttcgacctccgagaaatcttcctggcgatccaccatatcgtaaaataccggggaaactttttgcaagacaccccagtaaatagtttcgtagcctcaaaaatcgacgttgcctcattcctaacgaacgtcaaccaagcctacgcagacaagtacggcgaggaacaaaacttcatcgaactaaatgaaaacaacgcggcggccatagaggcagtaatccgagggaaagacaaggacaagacgaccaaacaattagacaaagccaagaaaataaccaaactactgcaatccagtacaaacaaatacgagaagaacgtaacccggcaaattgcaaacgcaatcatcggctacaaaacccaattcgagaccatcctcggcaaggacatcgacaaaaacgacaaggcagactgggagttcaaactcagcgacggcgacgcagacgacaagctggagaacctactgccagagttcgacgataacgaccaatatatcgttgccgaaattaagaaactcttcggaagcatagcactttcccaaatcgtatacgagaacatgaccctgagtcagagcatgaaatgtaaatacaaagaccacggcgaagactacgacctactaaagcaatatatcgccaccctatcagaccactcccaggtccggaaactcctactcgcctacgacttgtatgtaaacaatagacacggacgcctcctagaagccaagaaagagttcaaacaagacaaggcgctgacacaagacgagttctataaaatagtcaaagagaacctagacgactcccaactagcccaaaagatcctgcagaagattgacgaaggcaagttcatgccaaagcaacgggtcaacaaaaacggttacataccataccaactccaccaaatcgagctggaccagataatcgcgaatcaatcaaaatactatcctttcctcgcggaagaaaacccagtcaaagagcatagaaagcaggccccctataaactcgacgaattagtacgcttcagagtgccgtactacgtcggacctctaataagcccagacgacaagcgaaaggatgagcaacagaacaaaaaccatgagatgttcaagtttgcctggatgaaaagaaaagatgacaatggtgcaataacgccctggaacttcgcccagaaagtcgaccgggagaccagcgccaatcgattcataaaacgcatgaccgtcaaagatacatacctcatcggcgaggacgtgcttcccgcccgttcccttctataccaaaaattcgaggtgctaaacgaactcaacaacattagagttaacgggaaacgactggaacccaagttcaaacaaaaggtattcaacgagctattcaagcagaagaataaagtcaccaaaaaggctttcaaagagttcatcctccaaaacacaggaatgaaaaccgcagaaatagatggtctggccgacccaaccaaattcaacagtagcctctcgtcctactatcacctcaaatcgaccaaagtattcgacaaacaactcgacgacccccaatatcaagctgacttcgagaaaatcatagaatactcctccatattcgaagacgccgaaatataccaagaaaaactccacaaggaaatcaaatggctgactccggctcaattcaaggcaatcgccaactggaggctccaagggtgggggaggctaagcaggaagctcctggtagagctcaaaggcaaaggtggagaaaacataatttatcaactatggaccacccagaaaaactttatgcaaatcgtgaacgaacccgagctcaaaaaggccatcgtgaaagaaaaccaccaagctaccgaagagaagggaattgagaaaatacttgacgactcattcacatcccccgcaaacaagaaagccattagacaagttataaaagtggtcgacgacgtggtcaaggcagcaggaggaaagaagcccgcacaattcgctatagaatttacacgcgaaccaaagtggaacccccacctaagcaacatacgtggaacgaagctcctgcaagtctacgaggacacagccaagaagctcgtcgatcaatcgcttacggactccctgagagaaaacatgacaaaccgaaacctcctgaaagacgaatacttcctctactttatccaaggcggtcgagacgcttataccggtaagaaaatcgacatcgacgacatacccaaaaagtaccaaatcgatcacatacttccacaatcgttcatcaccgacgactccctagataaccgagtgctcacagagatcgaaatcaaccaaaagaaaggcaagaaatacgcatcacacctattcgccccaaaaccggccttcggcctgaatcaatcgatcagtgaaatgtggaaaacctggcaaaaagcaggactgatcagccaacgtaaactcaacaatctactcttcgatccagacctcgtaaaagacaaacagaagaaaggcttcattaaccgtcagttggttgagaccagtcaaataatcaagctagtctcgatcatcctgcaagacaaattccccgacaccgaaataatcactgtcaaagccggctataataccgcactgagaaaagaactaaaactatacaaatcaagggaggccaacgactaccaccacgcaatcgacgcctatttaacagctatatgcgataatttcctctatcaggtctacccgaacttcaggcctttcttcgtttatggtcaattcaagaagttctctcaagacactgataagcaaaagaaggccgtcaaatactacggcctcaagaatttcctccttcccctactagacgactcaacgggggacgaagtcatggtcaatcacaccaaacacgtagtgttccacaagcaacgcgacatcttcaaccggctaatccaggcatataactacaaatacatgttggtcagccgtgaaacaaccactgaaaactccaacatgttcaacatgacaatctacccgaggggcgaacgggaccgcaagaaaacccgaaaacttatccccaaaggaaaagacctcgatcccgccatctacggcggctactccggcaatacagacgcatacatggtcatcgttaaaatagagaaaaccaaagaaacactatacaaagttgtcggagtacccatgagggccctggccagcctcaaaaaggcacaaaaggaaggaaactacgaccaagaattaaacaaagtcttagaacccctaataatgttcaataagaacggcaaaagcaaggcgggcatcaaggggttcaccgtagtaaaagaccacgtacacttcaaacaggtcgtaatcgatggagacagcaaattcatgctctactccgcccaataccgcgcgaacgccaaacagctcaccctcagccaagagaccatgaaagtagtcacagacaacaccgacgatatggaccaaaagaacgcagacaaggaccaattactgctcaatgcatacgacgaaatcttagaaaaggtagaccagtacctcccactgttcgacatcaacggctttcgacaggggctccacgacggcagagccaaatttgccgccctcaagacaagtgaaaagaaatacacgctcaaaaatgtcctgaatggcctgcacgacaacctggtgacaccaaacctcaaaaatatcgggataaaaacgccatttggtctcatgcaatcctcatccggtataacactaagcccgaacgctaagctagtattccaatcaccgactggcctcttcgagaaaagggtcaaactgacgaatttgtga

SEQ ID NO: 6771 - RNA, 4203 nt, synthetic construct
  misc_feature 1..4203: note = Cas9 variant
  source 1..4203: mol_type = other RNA
atgggaaaacaaaaattcaacgactactaccttggatttgacatcggcactaactccgccggatgggctgttaccgatctccaatacaaactcctccggttcaacaagaaagacatgtggggctccagactgttcgacgaagcgcagacaagcaaagaacgacgcgtatacaggaacagccgccgacgcctggaccgacgcaagaaacgactcaaactcctagaagaactattcctagacgaaatctcgaaaatcgacaacacgtttttcaaaagactcaaagaatccaacctgtataacgaagacaaaagcatcaaattcaactaccctctcttcaacgacaaagactatactgatatcgacttctacaacgaatataaaaccatctaccacctccgcaaagacctaatcttcgaagacaagaaattcgatataaggctcgtattcatagcactccaccacatactgaaatatcgaggccatttcatcttcgaggggcaatcgtttgaagaaataaagagcttcgactcaatattcactcaactaagtagctactttctagaaaatttcgacttcaacatcgatgtctccattaaagagaaactagaagaaataatactgtccgacaacacaaaatcaataaagaaaacggagttcaagaaaatcttctccgataacaaagtcctcagcgttctcaacatggcgatcggatccaaagtctcattaaaagacgtatttaacaatgaggagctcaaggaacagaaaatctcattcagcgaaatagactacgagaacgagaaaagggacgaattttatcaactcctcggcgaggacattttcttaatagacctcgccaagaaaatatatgacttcatggtactcaagaaaatactcaaaaacacggactcgttcagcgcctcgaaagtcgccctatactgcgagcataagaaagacctcgatgacctcaaatatatattcaagaaatacctaacaaaagaagactacttcaagttcttccgatctaatgtggagaagatcaactatccatcgtacataggtctcaataaaataaaaagcaaaaagatcatcaaagaaaacaagtgctccatctcagacatcaataaagaactcaaaaacaaatacctgaaggatataaagctcgaagccaaggacaaagagctatttaaccggatattcaacaagctcgacgaatttaagttcctcgagaaactcaaaagcagcgaaaacagcaccgtaccgtaccaggtccacgagatcgagctgaagaagatcttagacaaccaaagaaagtattacccctttctgaacgagaaaatcgacgggaagagtgtctacgaaaagatcatccagctattcgagttcaagattccgtactacatcggtcctctgaatacggaccctaacgtgaaaggcaaaaacacctgggtggtacgcaaagacgaaaacaataagacgccaataacgccgtggaacttcgagcaaaaggtcgatatgcagaaaagcgcagaagagtttataaagcgcatgaccaaccgctgcacatacctaaaagcagaagacgtcatagccaaaaactccctgctctacgaagagttcatcctcttaaacgagctcaataaggtaaccgttgataacgaaatcctacacccgaccctgaaaacagaaatcatcaacgaactattcaagactaccgtaaaagtcacaaagaaaaagttcatcgagttcctgaaaaagaagcaagccgtaaacgatgtcgaatcaataaccggcataggggtcgagttcaactgcaagctccaaggttacaatacattcagaaagatcctaggtaagaaaatcgagaacgtcaacgtcaaaaacttcgtggaaaagtgcatcgaactaaagtgcctatatggatccgacaagaaactattcgagaacgccatcggaaagatttatcgcgaatacaacataacggacgaagaatttaacaagatcaaccgcctcaacttcaacaagtgggcgcgactttccaaaaagttcctcacggaaatttcgttcgagaaaaccgacggaaccaagcgctttgagagtgtcatagaagctctccgatcaacgaactacaacctcatggagctgctatccgacaaattcaacttgcaatccaaaatagacgaaataaacggcgaagacgacttttctaatatcgacataaaggaatacgtggacaaactctacgtaagcccctcggtcaaacgcagcataatccagacatacaagattgccatggagatcaagaaaatcaccaaaaaggacccaaagaaaatcttcatagaaatggccaaagacaaaggagaaaaaggcaaaacaaccgaaaaacgcaaagacaaaatcaaaaagctctacaagaatatcaaagacaccctctccgactactgcaacaatctccaggaccttacactccaagttgagaagtatgacgacaaccgcctccgccagaagaaactcttcctatacttcatgcagatgggaaaaagtatgtataccggaagatgtattgacctagaagacctattcaacaacaacgtgtacgacatagaccacatctacccacagagcaaagtcaaagacgactccttcgacaatatagtactggtagagaaagaagagaaccacagaaaatcgaatgaactgctcaaggaagagatccaaagccgaatgaataactactggatattcctccgcgaaaacaagttcatctccaaagaaaagtacaacagactcacccgcaaaaaggactttaccgacgaagaactaggcgacttcgtggcccgccaactcgtgacgactcgccaaagcaccaaggaaatcgcaaaattctttgagaaaatcttcgagaaaacaaccgtagtctatagcaaagcatcgctcgtatctgagttccgagaaaagtacgacatcatcaaagtaagagaagtgaacgacgcccatcacgcacaggacgcctacttaaacatagtcgtcgggaacgtattcaacaccaagttcactaagaattactggaaattcacaaaagacataaagcgacaaaacgaagagaatccaaacgagaagaaagggtacaacctacggaaaatttacgaatccgacgtcttctgcaacgactccgtggcctgggtatactccaaagaaaaccccaagtacaacactatcaataccgtgaaagacatggtttatcggaaaactgcaaacatcacgcgcatgctagtggaaggcaaaggccaattattcaacctcacaatcaaagacaaaacacagctaaagaagaacgtgggaaacatagtcgccaacacgccaatatccctgaagaacagaaagctccacctgaactccgttgaaatcgccaagaaatacgggtacttcgactctctaaacaacgcctatttcgtcctgttcaaatacgaagagaaaggcaaagagaaaattggattcgatagcattacaatagcgtacaaagaacggctgaagaagaacctcgacattgaaaagtttctagaaaacaagggctataaaaactcaaagctgatccgcaaaatcttcaaaaaccaaaaagtcctaataaacggatacccgtacctcctgaagtccttcaacaaacaatcacaaataaaattcaacaactttaagattctgtacctaaacgaaaacaacctcaagtttgccaaagatgccatcaagtttgagaagaacaatgccaacgtagacctcaagaagcagaaatatatcgtcagcttcctaaagaagaagaaacagaacgagataaacgagacctatgaggagtgcatagaccgcctcaacgacgagttcgacactctcttcctgaaactgtgcgatatccagaaaagcagtatctacactaactataaattacaagacttcagcagtaataagaagtcaatcgagatcaaagataagttcgacatcttcaagagcttagacctctacaagaaaagcaagctcataaaagagttcttgaactactacaagtatgagaagaacgacttggacttctcgctgattgacatagacaaaaaggcaaactgcatacaaaaacacttcacggaagacctcgtcaaagacttcgtaatcgtcgacgaaagcgtgacaggcctctttgtgaagaaagaacggctcaaatga

SEQ ID NO: 6772 - RNA, 4203 nt, synthetic construct
  misc_feature 1..4203: note = Cas9 variant
  source 1..4203: mol_type = other RNA
atgaaaacaatcaccgaagactacatcctgggactagacataggcacaaattcatgcggctgggcagtaatggacaagaaaaaccgcctcctcagactaagagggaaacgagccatcggtagccacctcttcgaagaaggacactctgcagccgaccgcaggagctttaggactacgcgccgacgactaaaacgccgaaaatggcgcctcaggctcctcgaagagatattcgccgaacccatggccaaagtggatcccgccttcttcgtccgcctacatcaatcctgggtatcccctttagacaaggaccgtaaaaagtaccacgcaatcgtatttcccaccgccaaagaagatcacgagttctaccacgactaccccacgatataccacctacgtgacgccctaatgcgcgaagacaggcagttcgacctcagagagattttccttgcaatacaccacatcgtaaaataccggggcaacttcctccaagatactcccgtaaattcattcgtagcctccaaaatcgacgtagcgagcttccttaccaacgttaaccaggcatacgccgacaaatacggcgaggaacaaaatttcatcgaactaaacgaaaacaacgccgctgccatcgaagcagtaatacggggcaaagacaaggacaagactacgaagcaactcgacaaagcgaagaaaataacaaaactactccagagcagcacgaacaaatacgagaaaaacgtcacacgacagatcgcgaacgccatcataggctacaaaacacagttcgaaacaatacttggaaaagatatcgacaaaaacgacaaagccgactgggagttcaaactctccgacggagacgctgacgacaagttagaaaacctcctccccgagttcgacgataacgaccaatacatagtggccgaaataaagaaactcttcggatcgatcgccctctcccaaatagtctatgaaaatatgacgctatctcaaagtatgaaatgcaagtacaaagaccacggagatgactatcacctactaaagcaatatattgccactctatccgaccacggacaggtcaggaaactgctactcgcatatgacctatacgtcaataatcgacacggtcgcctgctagaagcgaagaaagagttcaaacaagacaaagcactcacccaagacgagttctataaaatcgtccgcgaaaacctcgacaattcgcagctagctcaaaagatcctccaaaagatagaagaagagaaattcatgccaaaacagcgcgtcaacaagaacggcttcatcccctaccaactacaccagatagaactagaccaaataatagccaaccaatccaagtactacccatttctagcagaagagaaccccgtcaaagaacaccgtaagcaagcgccatacaagctggacgagctagttcgattccgagttccttattacgtggggcctctcatatcccctgacgacaagcggaaagacaaacagcagaacaagaatcacgaaatgttcaagtttgcctggatgaaaaggaaggataacaacggagcaatcaccccatggaacttcgctcaaaaagtagaccgggagacctccgccaaccgcttcataaaaagaatgacagtaaaagatacctacctcatcggcgaagacgtcctacccgcacggtcgctcctctatcaaaagttcgaagtattgaacgagctgaacaacatccgagtgaacggaaaacgcctcgaaccgaaattcaaacaaaaagtattcaacgaactcttcaaacagaaaaacaaggtgaccaaaaaggccttcaaagagttcatcctacaaaacacaggcatgaagacagccgaaatagacggactcgcagaccccactaaattcaactcgtcactctccagctactaccacttaaagtccacaaaggttttcgacaaacaactggacgaccccgaataccaagccgacttcgaaaagataatcgaatatagctcgatcttcgaagacgcagaaatataccaagagaaattacacaaggaaataaaatggctcataccagcacagttcaaagcgattgcgaactggcgcttacagggctggggacgcctttccagaaaactgctggtcgagctcaaaggaaagggcggcgaaaacattatctaccaactatggacaacacagaaaaacttcatgcagatagtcaacgagcctgagctgaaaaaggcaattgttaaagaaaaccaccaggccacagaagaaaagggcatagagaagatcctcgacgattcattcacaagccccgcgaacaagaaagcgatcaggcaagtgatcaaagtggtcgacgacgtcgtaaaagccgccggcgggaaaaagcccgcacaattcgccatcgagttcacccgagaaccgaaatggaacccgcagctctcccacatcaggggaacgaaactactccaagtctacgaagatacggcaaagaagctggtcgatcagagcctgaccgatagtttaaaggagaatatgacgaaccgcaacctactgaaagatgagtacttcctctacttcatacagtgcggccgggatgcatatacaggaaagaaaattgatatcgccgacattcacaagaaatatcagatagaccacatactaccacagtcattcataacagatgatagcctcgacaacagagtactaaccgaaatcgagatcaaccagaagaaacacaagaaatatgccagccacctcttcgccaccaaaccagcgttcggtctgaaccaatccatatccgagatgtggaaaacctggcaaaaagccgggcttataagccaaagaaaactaaacaacctcctgttcgaccccgacctcgtaaaagacaagcaaaagaaaggctttatcaatcgccagctcgtagagacctcacagatcataaaactcgtcagcatcatcctacaagataaattcccagacaccgaaatcataactgtgaaagccggatacaatactgcactccggaaagaactcaaactctataaatcgagggaagccaacgactaccatcacgccatcgacgcatacctaactgcaataaacgacaatttcctgtaccaagtctaccccaacttccgccccttcttcgtgtatggccagttcaaaaagttctcccaagacacggacaagcaaaaagaagccattaaatattacggtcttaagaacttcttggaaccactactggacgacagcacgggagatgaagtaatggtcaaccacacaaaacacgtcgtctttcacaaacagcgagacatattcaacagactcattcaggcttacaactataaatatatgctcgtatcgcgggaaaccaccacagagaacagcaatatgttcaatatgacgatttaccctagaggcgagcgcgatagaaagaaaacccgcaaactcatccccaagggcaaggaccttgaccctgccatctacggcggttacagcggcaacacggacgcctacatggtaatcgtaaaaatcgagaaaacgaaggaaacgctttacaaagtggtaggggtacccatgcgcgcgctcgccagccttaagaaagcacaaaaagaaggcaactacgaccaggaactcaacaaggtcctcgagccgctaatcatgttcaacaaaaacggcaaaagcaaagcgggcataaagggattcacggtcgtaaaggaccatgtacacttcaaacaagtcgtcatcgatggcgactccaaattcatgctctactcagcacagtaccgcgccaacgcaaagcaacttaccctaagccaagaaacaatgaaggtcgtgaccgacaacaccgatgacatggaccagaagaacgcagacaaagaccaactcctgctcaacgcatatgacgagatactagagaaggtcgatcaatacctgccactatttgacattaacggcttccgacagggcttacacgacggacgcgccaagttcgcagccctcaaaacctcagagaagaaatacaccctcaaaaacattctaaacggcctccacgacaacttggtaacacccaaccttaaaaacattggaatcaagacaccattcggtctaatgcagtcttcgtcaggaataacactctctcccaatgcaaagctagtcttccaaagcccaaccggcctattcgaaaaacgagtaaaactcacaaacctttga

SEQ ID NO: 6773 - RNA, 4203 nt, synthetic construct
  misc_feature 1..4203: note = Cas9 variant
  source 1..4203: mol_type = other RNA
atgaagacaatcttgggacttgacttaggaaccaatagcatcggatgggccctcgttaaagaaactgaaaacagcaatgaaaagagtgagataatcaaactaggagtcagagtcaaccctctaacagtcgacgagaaaaccaatttcgaagcaggacgcccactaagtacgaacgccgaccgaacagccaaacgaagtgcccgccgcaacctccaacgctacaagctccgacgcaagaacctcatagatctactcatcaaacaccgcttgatcgacaaagacaccccattgaccgaaatcggcaaaaacacaacacaccaaactctagaactaagagccaaggcagcccgcgaacgaatcgagctcgaagacctggcccgagtcttcctcgcgatcaacaagaaaagaggttaccggagcagccgcaaggttaacaatgaagaagagggtcaggtcgtcgacggaatggccgtagccaagaagctctacgacgaaaaccttacacccggccaatacgcgtacgagctcctcagcaaaggcaagaaatacgtccccgacttctataggtccgacctacaggcagagttcgactctatatgggaataccaaaaacaattctatgccgacatattagatgacgaactctacaacgccctaaaaggtcaggggcagcaaaattcccgcaaacgattcctagccataaaaggagtctacacagccgaaaacaaagggaaaagggacgaagtcaagctgcaacactacaaatggagaagcgaagcaataacccagaagctgtcaatcgaagaagtagcatacgtgctagtggagatcaacaacgatctcaacaagagctccggctacctgggagcgatctccgatcggtccaaggaactctatttcaacaaagaaacagtaggggaaaacctgtggaagcaaatccaaaagaacccacacacaagcctcaaaaaccaagtcttctaccgccaagactacttggacgaatttgagcagatatgggaaacgcaagcacaattccacccacaactcacactcgctctgaaagaacaaatccgggacgtggtaatcttctatcaaagaaaactcaaatcacagaaaggcctccttagcttttgtcagtttgagtcatgggaaattgaacgaaaagatgaaaacggaaacgtgatcctcaacaaaacgacccagctaccaaaacgccaaaccgtcggccgccgagtcgcaccgaaaagcagtcccttgttccaagagttcaaaatatggcagaacatcaacaacctcgaaatcgcgaagatttccgacggcaatagcaagaacaagaaagaaaccgaagcactaagtgacgacgaaagaaagctcctgttcgaggaactaaaccttcgcggcaacttgtcccaaaaagaagtgctgcagatactcggtttaaaagacaaagaatacaagacgaacttccccgaaggactagaaggaaacaggacgaacgccgccctgttcaacatatatcagcaaatagcggaaaacgaaggatacggcgattggacaaagaagtccgcccaagagattaaggaggaactaaaagcggtcttcccgcagataggaatccaagccgacatacttgacttcaacgcagaactagacgggaaagagttcgaaaaccaggcatcctaccaactctggcacctcctctattccgccgaagaagacgacaagatcaacgaagaagatcaaataatatacgggaacagcgcagtctcactcaagaagaaactctgtgaaaaattcggcttcacccccgaatacgccaaatggatcgctaacgtgagtttacaagacgactacggcaacctgagcaccaaagccatgcgcaaaataatcccatacctaattgacggaaatgactactccgaagcctgcgccctagctggctacaaccacagcaactcgctcacaaaggaagaaaacgacaaccgcgaacggctgaacaaacttgaactgttaccaaagaacagcctccgtaacccggtcgtagagaaaatcctgaaccagatggtcaacgtggtcaaccaagtcattgaaacatatggcaagccggacgaagttcgcatcgaactcgcccgcgaactcaaaaagagtgccgaagaaagagcagaaatgaccaaaggaatcaacgaagccacacgtcgcaatgaagatatcaaaaagctaataaccaaaaacttcggaatccccaacccaacgaaaaacgacgtagtccgctaccgactgtgggaagaactggcccctctggcgtataaagacgtcttcaccggccgacaaatcaagaaggaagacctattctcatcgaaaatagacatcgagcacataatcccaaaagcgctactcttcgacgactcattctccaacaaaaccctggccttcagagagacaaacctaaagaaagcagaccgcacagcatatggcttcatcgagtcagactacaatgccacactagacgactacatacagagagtcgagacactgtacaataacgcgaaagggaccatatcaaaggggaaaagaaacaaactcctgatggcccagaaaaacctaccagacggattcatagaacgagacctccgaaacagccaatacatcgccaaaaaggccaagagcatgatcgaaaaagtattcaacgacgtcaatgtcacatcgggcagcataactgaccggctcagggaggattgggacctgatcaacgtaatgaaagaactcaactttcccaaatataaagcgctcggcctcaccgaaatcgaagaaaggtacgatatagggcaagagaaaacgaaaaaggtcgaggtcatcacggactggaccaagcgtaacgaccaccgccaccacgcaatggatgccctcacggtggcattcaccacaaaatcccacgtacagtacctcaacaacctaaacacaatccatagcctcaaaggtgacgaagtcgacctcgaactctccaaactttacggcctcaagaatacaattacggaggtcgtgaataagaaacgaaaattcatcccacctatgcccaacttccgtgaggaagctaagaaacacatagaaacaatcctcgtctcaatcaagaacaagaacaaagtctataccaaaaacataaataaaaccaagaaagagtcgggataccatactaaagaacaattgacaccacgaggccaactacataaagagaccgtctacgggaagtcaaaaaggccaatgaacaaaccaacaaagatcaacaaaaacttcagccttgaacaggcccaactcataatcaacgtacaagaaaaagagctggtgctaaggcacctcgcacagttcgacaacaaccctgcagtcgccttcgacaccaagacactgaaaaagatgccgctcctcaaaaacggagaacccctcaaggaagtactatgtttcgaagaaatattcaccatacggaaagacatcacaccagacctcaagatcgagaaagtcgtagacgagaaaatcaaggccattctcgaacaacggaaaaaggacttcgggggaaacgccaaagaggcattctccgacttagacaaaaaccccatctggctgaacaaagagaagggcatatgcatcaagagagtcaccatcacgggggtaagcaacgccgaagccctacatcaccaaaaagaccatctcgggcgcgagatcctagacgacaacggaaacccgatcccggctgacttcgtcagcacgggcaacaatcatcacgtggcgatttacgaggacgagaaaggaaagctccaagaaaaagtagtctcactatacgaagccgtcgcgcgcgcgaaccaaggcctcccagtagtggacaaaggactgaacgaagatttaggctggaagttcctgttcacaatgaagcaaaatgaaatgttcgtattcccaaatgacgacttcgatgtcaacgacatcgacttgctcgacgagaacaacgccaaaataataagccagcacctattccgagtccaaaaactggcgacgaaaaactacatgttccggcaccacctggagacaaacgtacaagaggtcaaggaactcaacgacatcgcctacaagtcaatccggagtaccgaaccgctaaagaacatcaaaaaggtgcgaatcaaccacatcggaaaaatcgtacaggtcggagaatactga

SEQ ID NO: 6774 - RNA, 4209 nt, synthetic construct
  misc_feature 1..4209: note = Cas9 variant
  source 1..4209: mol_type = other RNA
atggcgaagaaagactacacaatcggcctagacatcggcacaaactccgtaggttgggctataattgacgataacctgaaactcctcaaacgcaacatgacaataaagggaaataccgacaaaaagtccgtaaaacgggacctctggggcagcctgctatatagcggaaatagcgacaaaacaaccagcgcagcagacgcccggtcgaagcgagggcttcggagacgcctccgtagacgaaaatacagactcgaccggctgaaacaaatcttttcagaaatcatcaatgataaagcccccaactttttcgacaaactaaacgagtcgtttctcaacccaaaggacaagaaatacggaaaatatcagatcttcgacacagaaaaagaggaaaaggactattaccggaggtaccccaccatctaccacctccgcaaagacctgatcgaatccagcaaaaagcaagacataagactcgtctacctagctctagcccacatcctaaaaagcagagggaacttcctgttcgaagggaacatcgacgatctcaagaacgacttcgccggcatatacgaagaggtagtggaactatgcatgaccatcaacgcagaagacgtcgacttggagttcgaggaggtagacaaacaatccctaaactccatcataaagaacgaagatatctcagaaatcgaacagggactagaaaacttcgccgacgaacacgtaatattcaaagaacaaaacaaaaagaaaaacgacctctttagcaactgctgtaaaatcatctgtggccacaccgtcaaagccaacaaattcgccagcgagctagacagcgaactgttcattagcttcaaaagcgacgactacgttgacgtgatagatgtgatccaatccgggaacgagaacatcgcaaacctactgctggcgtgtagaaaggcatacgactacataatgttcaaccgactcgtcgacctaaacatagactctcccgccaaactctcaagcaacatggtatcactctacaaccagcacgaaaaggacctcaaggcctacaagaaactcatcaaagagttcaacaaattcaaaaggtcaaacggatgcaaagacctcgaaatgatcatcctcaccgcagacgacattgacagcttccggaagaaagtggacaaaaaggaaggaaaactcaatgggataaataagaaaataacacatgagcaggcccttaagaaacagctcaaagatatgaagaaaatacttgaagacaaaaacacagaagccgaagacaaacaaataaacgacattctaaaaatgatcacgtcaatagaagaacgcgtcaacaaatcctgcttcctcaaaaacctacgatctaccgacaacgcctccatcccgaaccaaatccaaaggcaagaaatggaagctattcttgacaaacaagcgaaattctaccccttcttgaacgaacacaaagacgaactactccaactcctctcgttccgcatcccgtactacgtaggccccctagtcaacaagaagtacagccgcttcgcatggctagtacggaaagagggacaggtccaaaagatcaccccaaccaacttcgatggcgtagtcgataaacacaaaacagccgagaaatttatggaaaggctaatcgggaaagatgtctacctcccaaacgaacgagtactcccaaaagccagcctcctttaccaagagtactgcatattcaacgagctcacaaaagtcgcatacatcgactcaacgggcaagaaaaacaacttctcttcagaggagaagctcaacatattcgagaaactcttcaagaccaaaagggaagtaaccaagacggacttgtgcaaatgcctcaacaatgtctgcaagctcaaagaaaaggtaaaggaaactgaaattataggcatcaaggctaaattcaacgcgaaatactcaacgtaccacgatctaaagaagatcaacggcatggagcaacttatcgccgatgaagagggcaagccgctctgcgaggacatcatctccatcctaaccatattcgaagacaaggacatacgcctcgtccgcctcaaagaactgctctgtcaaaacaaagacctgattaacaaattctccctttccgccgagaagctcgctaaagtactaagcaccaaacactacaagggcttcggaaacgtctccgccaagctaattaacggcattcgagacaaaaactgcaaaacaatcctcgattatttgatcgaagacgacaaagaagcatactacggccgaaacaaccccaatcgcaatctaatgcagctggtcaacgacagcagattagcgttcaaaggacagatagatcgcgagcagaacacccacctggaagatctgtcactggatgagttccttgacgatctctacgttagcccatccatccgacgaggcatccgcttaaccattcgcctggtcgacgaactcgtcgaaataatggggtacctccccaaaaacatcgtcatcgaaatgcccagagaagacggggaaaagggcaagatagcagacacccgctacagcaaattagagaaaatgctcaaaaaggacgcagcccttgaagacctctaccgggtgctcaaaacatacgagaaaaacaaaaaggcgcttgccaatgacgcactttacctgtatttcctgcaaaacggccgagacatgtacacgggcaaagaaatcaatctctcagaactccatagttacgacatcgaccacatcatccccaaatcatttaaatacgacgacagcctagacaacaaagtactaaccgccaagaaaatgaacatggacaaacgaaccggagccctcgatcacaacataatcgaaaatcaatgtggattctggcgggtcctgctgcaacaggacaaaataagcctggaaaagtatacgaacctcatgaaaacggagttcaccgaagcggacaaagccggcttcatcatgcgacagctagtcgaaacgagacaaatcaccaagttcgtcgcccgatacctcgacaacaaatttaacgggctgatctcggatcccaacgacaaagttaacatcttactcccacgcgccagcttgtgccaccaattcagggaaacattcggcttctataaagtcagggaactgaacgacatgcaccatgcacacgacgcttacctcaatgcggtaatcgccaacacactaaacaaaaacgcatacctcagcgatctgctcaaatacggagcctacagcaaatacaaaaagaacgggttcaacaacagcaacggcataatggactacttcggtaacacccaattcaactgcctgtttgtcgtcgaaagaaccctagacaaatgcagagtcaatatcgtaaaacaccccgagacagcctccggcgagttctataatgaaactatacaaaagaacaaagtcaacggcggatcctctacacgcagcctcaaatcatccgtcaaggtgctccagaacaccgaacagtatgggggcttcacaaacgtaaacaacgcatacttcattctctttgactacaaggctaaatccaagctcaagagaaagctcatcggagtccccatcgtagataggcaaaagttcgaacaggacccagtgacgtacctcgaggcgaaaggttttgacgaaccgaagttagtccagaaactactcaaatacacgctcctagaatatgaagacggcaaacgccgatacctcaccggcgtcaccgggaaacgatgtgaactggtgcgagccaaccagctcctcctcccacgcaacatgatggcactcttgcaccacctccaagaatggcaaaagcacgacttcggaataaaagaaatgacgaaggttatcaagaacaccaacaatatagaggccaaatttgacaaactttttgagcatatgatgaagttcatcgacaagtacagcgaaccacccaagatcgtaagctcaaaaatctcagaagaatatcacaagctaagagagtccctatgccaagatgacaacaaaataaagatctacgccgaaatcggcaaagcccttttatcgctgctgcacctagttgacagcaagtctgcctgcgtcttcaagttctctgggctcgaaataaaccgcatccggtaccagtcaatcaacgaaaagaaggaaccagtcataatcttccaaagcctgtccggactgcgcgagtcacgatacaaatataatcaatga

SEQ ID NO: 6775 - RNA, 4209 nt, synthetic construct
  misc_feature 1..4209: note = Cas9 variant
  source 1..4209: mol_type = other RNA
atgaaactacgcaacgcaaaggattacagcatcggactcgacgtaggcacgggcagcacgggttgggccgtcaccactctcgacggcgatctattcacattcaatcaccgccctacactaggctccagacttttcgagagtgcatcaactgcccaagaaacacgcgaagcacgcggtgcacgaagacggctcaaacgacgtcgttggcgcatctccctattacaagagcaattcgctgcggagatggagagttgcgacagcaacttcttcatccgactaaaccaatcacgcctatggcaagaagaccgtaccgaacaaggaaaaggatacctatttggcggcaaaccaattctctgcggagctcaaattttcgcaaatgagcaagaatattaccaacaattccccacaatcttccacctccgtaagttcctcgtcgagtgctcagaacaagtcgatctacgcctaatataccttgctctccacaacatcgtcaagtacagggggaacttcttataccaagacaacaaaacccttaacgtacgaaacttcaacttagactcccaaatagcggacttcctcgaccagctgcaactctggtgcgaaaacaacgacctctgcttccacgagatcgatggcacgacgacactcgcaagccaactaaatacctgcttccaccagcaatcaaaccaacagaaaaaggacacactgaaaacctttttcgcaacctgtatcgaaaacgacaagatagccggcgagctcaccaaagcactgctgggctacaaaaccgacttcaagataatcttcaacatcgaaggtgaaaaggacgagtacaaagccaaatgcaacgaagaagagaaaatccttaaattacaagaaaccatagatgatgctaaccaagtgctcctccaatccatcctcaacttatactctggcattatagtcgagaaaatcctcaacaacaccgccgtcaaaaatgaaagcgcacaatgcaccctctcggcctatcactgctactcctacgcactctactccaaacaactgcggacgctaaagaagctagtcagaaaatacaacccacaacgatataatgaatgcttcaaccttagcgccgaggaccccaaagccaagaaacagctctgtacgtacgccaggtacaacgcgcaacactcgaccgattacgacgagttcaagaaatatataaaagacctatttgagaacaccgatgccgtcaacgatgcagcgtaccaacagatgaagcaagatttcgacgaagaaaaattcctccgacgacagaaaacctccgacaacggagtatacccctaccaattccacctcgaggaaatgcaactcataatagaaaaccaagcccagcactaccctttcctaaccaaaatcaagccgaaattagaatcgctggtcaccttccgcatcccatactacgtcgggccacttacgcaaaaaggaatacaacgcaacggccggaagttcgcctggtcaaagcgtaacaaagacgccgaaaaccaacgcatctacccctggaactgggactccatcatagacaagtcagcctcagcagaagccttcatcctccgaatgaccggcaagtgcacctacctttacggggaagacgtactgccaaaggaaagtctactataccaagagttctgtgtcctaaacgaactaaacggcgcccgatggaactgtgacggcgaaagaagaatgcccctctcaaacaaggactgcaaggccatctaccgccagttattcctcaagaaacaaaaagtgagctacgcagatgtctcaaactacctgaaagcacaagggcatataaacaacagcgttgcaggaggccaaggcgaacacggcttcgagagcactctttcttcgcatcactttttccggaaactcttcaacgtcgacgccgccaacgaccttacagcgcagcagatcgagaccgccgaacaattaatcctatggggcaccatcttcgaagacaaagagatattcgagcagaaaatcaaagaacgattcggggacatgttctccaaagatgaaataaaaaccatcgcgcgcaggaaattctctggatggggcaagtgctccaagcaactcctctcgggcctaacagtcgaaaccccaagaggacgggaatccataatcgacgtgctaaggaacggacaccccgaaaacggacgtaccttggtcttcatgcaagtcattacagacaaaaagctcgagttcgacaaaaagatagaagaatataacaatgaacacctcgccaagacaaacgagtccgttctggacacggccataatgtcccccgcgatcaaacgtggagtcaaccaagccctccacatcgtgggagaaatccggcgcatcacaaaacatgaccctacctgcatctacatagaaacaacccgcgacgaaaaggacggaaaacacaacacccgaacaagctcgcgctactcaagcctcaagaaaaacctcgaaaccctgaaaagcatcgataaagcaaacgcccccgcaataaagcactcactcgagctcctggaaacatacaaaaagcaaaacattgacgacaaactcttcctttactttactcaaaacggaaaatgcatgtattcagggaaatcactcgacattaacaacttgtccagctaccaaatagaccacgtgattccccaatcatacataaccgataattcattcgacaacagagtactcgtgtacgcatcagaaaaccaaagaaaatctgactcactactactctccagcgtaatccaggccaaacaagaaccattttggacgtcgctcgaaaaggcgggacttatcagcgagaagaagcacaacaacctcaaaagaaagtctctgtccgacgcgcaaatcaaagggttcatcaatcgacagctggtcgagacatcccagatagtcaaagtcctcagagacgaactctcccgaatcttgcccgacacaaagatcatcccagttaaagcctccctaagccacgacgtccgcatcgcctgcaatctctacaaaagccgcacagccaactccttccaccacgcacacgacgccctactagcgtccaccatgggaagatttgttcagacacggttccccgacatgtacgaaaaccccgtgaggtatgtaaaaatcctcagggcttacattgcgcaatccaaacttcagcactcagcccagacacgcaactttgactcacggagctttatggcccactcattcttctgcgattactccaacgagaacggcgatactatctggaacagcgcctcagaaatcgaacgtctccgacgcgctctgtcatacaaaaacctatacctcacccgcagaccgttcatcgacgccggccagttctgggaccaaaccatatacagcccccatgacaaaaagaaaacgcccgactctctcatcccgctcaagaaaaatctcgacacccaaaaatacggcgggtactcaggaaaagactacgcacacttcttcatctactccgtactcaacaaacaaggtgacgtcgagtacagatttgatggcgtcccgttatacatcgcggccaacattaaccgtgatgatagaggggcgcttgctcagtacgccaagcagctagtcgagcacgaaaacgtgccaaacgccaaaaggaagacaaaagatctagtcttccaacgcatagaaagagcctgcgtccccaaatatcaattgatttgcatctctcaatgcagcggagactccgacaggtcagtatctgactactactacattactggcaagaaagaggttagaaatgccctccaactcgccttccccatgcacctatatggtgctataaacgcaatcgaggacaagaaagagctcgacgacagcgctctcgaggagctagtcgtctacatactcagaaatgcccctagaatcgccccagacgtcttccggagactcaacctgacggaaaaattagcggactgtttagacatcccagacagaatcgaactccaaaacagcatctacggccttttcaacttaatcaatgcagaaagcaacgttgtcaaccttcagattttcggaggggccaaaactgcgggtgtcaaactaatcaacttaaattcgctcctaaacgaccccgccaccacggtaaccttcatcgaccaatctgtcaccgggatgttcgaacgaaaagaaactatcggcatatcgtga

SEQ ID NO: 6776 - RNA, 4209 nt, synthetic construct
  misc_feature 1..4209: note = Cas9 variant
  source 1..4209: mol_type = other RNA
atgggaaagcaggaatttaacgactactacctaggctttgacatcggaacaaactccgtgggatgggccgtgaccgatcaacagtacaaactgctccgcttcaacaagaaagacatgtggggaagccggctattcgaagaggctaaaaccgccaaagagcgccgggtctaccggaactcgcgccgccgtcttgacaggcgtaagagaaggctaaagctcctagaggaactattcctagacgaaattctcaaggtggattcaacctttttcaagcgactcgaggaatccaacctctacaacgaggacaagagcataaaatttaactaccccctcttcaatgacaaagactatacagacattgacttctacaaagagtacaagaccatataccatctgcggaaagcactcgtcttcgaggaccggaaattcgacattaggctcttgttcatagcactccaccacatactcaaataccgcgggcacttcatcttcgaaggtcagagcttcgaggacataaagagcttcgattacatattcaccgagatacaggactggattttggagaacttcgaaatcaacatagacatcaacctgaaggaaaaactcgaggaaatcattctctcaaacaacaccaaatcaatcaagaaaatcgaatttaagaaaatcttctcagacaaccgaatcctggccatacttaacatgggagtgggatgcaaagtcgaccttaaagatgtctttaataacgaggagctcaaggaccagaaaatatcattcaccgaaatagactacgaaaacgaaaagcgagacgagttctaccaactactgggcgaagggatatttattgtcgacctagcgaaaaagatatacgacttcatggtcctgaagaaaatactgaaaaactcggactacttcagtgagtccaaagtagccttatatgaagaacacaaagaagacctgaacagactcaaatacatcttcaagaaatacctaaaatcatccgactactacaaatttttccggagcaacagtgagaaaacaaattatccttcctacatcggactcaataaaatcaaaaccaagcgacttatcgaaaacaacaaatgcagcataagcgacatcaacaaagaacttaaaaacaaatacctaaaagatatacaagtggaggcagaggacgaagaactctttaaccgcatccttcacaaaattaatgagaacaagttcctggaaaaactaaagagctcagaaaacagcacagtaccataccaagtccacgaaatagaactcaaaaagattctcgacaaccagcggaagtaccattccttcctcaacgaaaaatccgatggaatgaccctctgcgaaaagataatcaagttgttcgagttccgcatcccctactatgtggggccactcaacaccaaccccaacatgaacaagaaaaacaaaaatacatgggtcgttaagaaagaggaaaattccaaatcctccatcaccccttggaacttcgaaaagaaagtcgacgaacagaaaagcgcggaagagttcataaaaagaatgactaacaggtgcacatacctacgcggagaggacgtaattccgaagaactcactcctgtacgaagagttcgtgctactcaacgaattaaacaaggtaaccgtggacaacgagctcctacatcccacgctgaaaaatgaaatcatagacgagctattcaaaaccaccgtaaaggtaacgaagaagaaaattaccgagttcctaaagaagaaacaagccatcagtgacgtagaatcaatcacgggcatcgacgtcgagttcaacgggaaactacaagggtacaacacctttagaaaaatccttggcgagaaaatagaaaacctcaatatcaaaaagttcgtggaacgctgcattgaactaaaatgcctatacggcagcgacaagaagctattcaaaaacgccgtggggaaactctacaaggaatacaacgtcacggacgaagagttcacgaagatcaacaagctcaacttcaataagtgggggcggctaagtaaggaatttttgacaggcatcagattcgagaaaactgacggaaccgaacgattcgaatccgtcatcgccgccctccggtccactaactacaacctcatggaacttctatcagacaaatttaacctacaatcaaagattgacgaaatcaacggcgaagacgatttctccaacatagatatcaaggaatacgtcaatgaactctatgtctccccttctgttaagcgctcgatcatacaaacgtacaagatcgcgatggaaataaagaagatcacagggaagaaccccaagaaagtctttattgaaatggccaaagggggcggagaaaaagggaaacgaaccgagcgaaggaaggataagattaaggagctatataaaaatatgaaggacagcctcagtgactactgcaacaacctccaagacctaagtagccaagtggagaaatacgacgacaataggctgcggcagaaaaagctattcctctatttcatgcaaatggggaaatcaatgtacaccggcaacgacatcgacctgagcgagctgttcaacaacaacatctacgatatagaccacatatatccccaatccaaagtgaaagacgactccttcgacaacattgtcctcgtagaaaagcaagaaaaccactccaagagcaatgaactcctaaaacccgagatccaatccaaaatgaacaactactggatcttcctccgcgaaaacaagttcatctccaaggagaagtacaacaggctgacacgaaagaaaaacttcaccgacgaggaacttggggactttgtcgcccgccaattggtcacaacccggcaaagcacaaaagaagtcgcaaaactcttcgagaaaatcttcgacggcaccgaggtcgtatacagcaaggcctcactcgtctcggacttccgagagcgctttgacatcataaaagtccgagaagtcaacgatgctcaccacgcccaggacgcttatctaaacatagtagtgggcaacgtattcaacaccaagttcacaaagaattactggaagttcataaaagagaacaatcggaaaaacgaggaaaaccccaacaagaaagaggggtacaacttcaaaaacatctacgaatcagacgtcttccggaatgaagacgtagcatgggtcttctccaaagaaaacaaagaaatcaacacgataaagacagtgaacaaaatggtctaccgtaaaactgtgaacatcacagaaatgcttgtggagggaaaagggcagctattcaacctgacaatcaaagaccggacccaactaaagaaaaaggtgggaaatatcgtagccaacataccaaaatcactcaagaaccgcaacaccaaactcaagagtgatgaattggcaaagaaatatggatacttcgacagcctaaacaactcttatttcgttctgtttaaatacgtcgaaaaagagaaagagaaaataggcttcgacggaataaccattgtcgacaaagaaaaactcaaaaagaacagcgacatcgagcgctttctagagaacaaaggtaacaaaaacgcaaagctaatccgaaaaatatttaaaaaccagaaggtactcattgacgggtacccgtacctgttaaaaagctgcaacaaggataaagcgatccgcttcgacaacttcaaaagcctgtacttagatgaaaacgacctcaagttcacgcgcgacgcgataaagttcgagaaaaacaacgcggacattgatctcaagaaacaaaaatacataatttccttcttaaagaagaagaaacagaacgaaattaacgaaacctatgaagagtgcatagaacggctcaataacgagttcgacacacttttcctaaacctctgcgacatacaaaaatcacccatctacaaaaactacaaactaccagatttcatctcgaagaaaaatgttgtggaagtcaaagacaagttcgaggtcttcaaaaacctggagctatacaacaagagcaaattaatcaagaacttcctcaactacttcaagtacgataacaataagctcgacctcatcgcgatcggaatcgacagcaaagcaaactgcatccagaaacacttcacagaagacctcataaaagactttgtaatcgtagacgaaagtgttacgggactattcgcgaaaaaggaacgtctagagtga

SEQ ID NO: 6777 - RNA, 4209 nt, synthetic construct
  misc_feature 1..4209: note = Cas9 variant
  source 1..4209: mol_type = other RNA
atgacatacagaaactaccacatcggcctcgatattggcaccagctccgttggattcgccgtccgatacgataacggagagctggtccacaagaaaggctcaaacctagttggcgcccgcctcttcaaagagggggaaacggccgaggaaaggcgcttgaaccgaggagcacgccgccgttacaacagacgaaaatggcgcctcaatctcctcaaccaaatatttaaacctctgatcgaagtgaacgacccaaccttcttcaaacggctggaacaaagcaacctcgtaaactatgataaatccgaatcgttctccctactcaacaatcagtcagacgacaaactgcaccagcaattcccaacgatataccaccttagagactatctgatgaaatcaaccgaaaaagccgacatcagactaatctacctcgccgtccaccacatcgtgaaataccgcggcaacttccttgacgcctcacccgtcgacagtttcgaggcttccaacctcaaagtggatgaaattctaacccaaataaacctcctcctcgacaaccttaccgacgatctgcgcctcaacacccagtacgtaaccgacatcgaacagacactactatcaaacacagagagtaataaggacaaagagaaagtaatacaaaaactcctgctccacaaggaagccatcaaaatagataaggaccgtacagcccagatagccaaattagtcctcggatacaaggcagacatcgcaaaactcttcggaatcaccgaaaaactgcagacgccgaaactcgaactgtctgcagcaaacagcgacgacgccctcatggagttgtcggccgaactaaacgaagaccaaataggaatcctcctgcagctaaaaaccctgtactcacgcgtacgactcaaccagatcattccctccggcacatccctcagcaagtcgatgatcgaaaagtacgagctacaccacacacaactcaagagcttcaaggagaatatactactgaaacttcgccgaaacaccgcggtccgccggaacctggaactcgcatacgccctctacgtaggaaatgctcaaaccaagcaagaagtcttcgaacccaaaaaggcccgattcacgtccgacgacttcgccagcctcaaagcaaacgcaaaaagcgcgtcctcagttaaagaagcccccaaaaataccaagaccaaactaaccaccgacgacttctacaatatcctaaccgagctattcgccacatttgaatccgaattaagtgcagacgaagatatgataaaagaggtcgaacaaatcaaaaaggcaataactggtgacaactacctcccaaaacagaggacagaccaaaacgggaacatcccccaccaactccaccagatagaactccgccaaatactacaaaaccagcttccacactacccggaaatggacaaaatcaacgaacaaaaaccgatcgaaaaactggtcaccttccgagtaccctactacataggacccttaattacccccgaagaccaacagaaatcaagcgcagctaatttcgcgtggatgaagcgaaaagaacagggtgccatcaccccctggaacttcgacgacaaagtagaccgcatgcagtcagcaaccaacttcattaaaagaatgacagtcaaagacacctacctcatcaacgaggatgtcctacccgatcgatcgctcctgtaccaacgattcaaagtcctcaacgaacttaacctagtaaaagtcaacaaccaactactcagcatcggggagaagcaggcaatatatcacgaccttttcgaaaagcaaaagaccgtgtccacgaagaaactccaatcctacctacagagcgagcagggctacggagacaacatcgagatatccggactctcgaaccctgacaaattcaacaacggccttacaacctacatagacttcaagaacatctttggtgacctagtggaggacaccaccaaacaaaaggagttcgaacaaatcatcgaatggtccacggtcttcgaagaccgcgcaatcttcaaagccaaactgcaggaagtcaactggctaaccgaggaacagatcaaagcgctcgtagcaaaacgctactccggatggggacggctgtcgtatcgcctgctcgcggaactcgttaatgacaacggcgaacgaatcatcgacatcttatggaacaacaaaggcagcaacctcatgtccatagtgtcccaggacgagttccaacaacagatagcccgaatcaactcccacgaggtccaggagctaggtatggaatcggtcttagcgaacgcatacaccagcccccaaaataagaaagccatccgccaggtaatgaaagtagtcgacgacatccaactcgccatgaacgggcaagccccgacctctatctcgattgagttcacgcgaaagcccgaagaaaattccgaaatcagcaaaagcagatacgaaaccatcacctcaatctaccagagccttagtaaggacattgaaaaggaagttaaagataacctgaacaagaacaaatcaagcctcaagaaaaacttatccgacaaatactacctctacttcacgcagctaggccgcgacatctacaccaaccaacccatccccttcaacgaaataccttactatgacatcgaccacatcgtaccccgctctgtggaaatgaacgattccctcaacaaccgcgtcctagtagcgaagtccataaaccaaatcaagaaaaacaacgcacccatagattcctcactaaaaatcaccagtgaaacccggcagctctggaagaaactcctcgactccggcctcatcacgaaacagaagtattacaaactcagtagctcgattaaaaatacggtctccccctatgtgaagcaaggcttcataaatcgccagctagtcgaaacatctcaggttatcaaactcgtcgccaacatccttggaacaaaataccaaaacgacgacacagagattatagaggtcaaggcacacctcaatagcgaaattcgaaagacctttgaattttataaactccgagaacttaacgactatcaccacggattcgacgcctacctaacaaccctcgtaggcggctacctctacaacagatatccaaaactcagatcgtacttcgtctatggagaccacaaacgactcgacaaggcacaactctcagaactcaaaaacttcaatttcctgcacggcctcaccaacccaaaatcgggctccgacggattaatcaccgccagcggcagccagcaggtcgtgctagacagaaacgaaaccatcaaacgcctaaacaagatatacagatacaagtacatgcttatctcaagagaagtctttaccaaacaaggccagttctacaacgaaaccatctacccagccaaaccaaacaccgcgaagatgattccactcaaagacaacaagccaagcgaggtctacggcggctattcgagctcgaacgtcagcaaaatagcgctcatcaaggagaaaaacaccgacaactaccaattcatagggatccccattagaagcatcgccaaactgaaacaagcaaaagctaattcaaagacggtgtatcagactgaacttaatcgcgtaataaaaagcgttctcgcgtcccagaaaactaagaaacaaaaagaatttgaagtaatcctagacaacgtaaaatataatcaagtcgtcgtcgatcaaggcgaaaaatattacctcggatccccctactacaagaaaaatgcgaaacaactcgtcatctcccctgaatcggtcaaaatactagcggacaaagccacagcagacctacctgaacaagaggcccacaataaactcatgacagtatatcaggaaatcgtggacgtactaaacaaacactttgcattatacgacatcaataatgtaaggaagaaactcaacgacggtctcatcaaattcagccaactcccgaactacgacgagaccagcaaaaaccgctttgacatcagtaagtccatcaagacgaagtatgcggtcatcatgagaatcttgtcaggaatcaaaaaccaaacaagcgaagtacccgagctggggctaaaatccccactcaacaagatgcaaaccaaaggcggtataaaaatcagccctgaagcgaagatatactactcaagccccaccggtatattctcacacttcaagcaggtcaagaacctctga

SEQ ID NO: 6778 - RNA, 4209 nt, synthetic construct
  misc_feature 1..4209: note = Cas9 variant
  source 1..4209: mol_type = other RNA
atggaacgaatactcggactagacctcggagtaagcagtatcggttgggcgttagtcgaagaggacgtgaaaaacccagagaacaacaaaatcatcaaacttggcgtacgagtaaacccgctaaccatagacgaaaagacaaactttgaaaaaggaaaaagcatcacaacaaacgcaggccgaaccagtgcgcgcagcgcgcgccgcaacctccaacgctttaaactccgccggaaaaagctgcttgaaatcttaattcactataagatcatcaaaaacgacgccgttctggccgaaacaggaaagaatacgacattccagacccaatatcttcgagcaaaagcagccagagagaaaatcgaactagatgaactcgcgagggtgctactactcatcaacaagaaacgcgggtacaaatcgtctagaaaggtacagaacgacgacgacgggaaggccatcgacggtctctcggtggccaaagagttatacgagaaaaactacaccccgggacagtacgcgtacgacctcctaaaacgaggcaagaaacaaatcccagacttctaccgctccgacctgcaaaacgaactcgacaggatatgggagttccaaaaacagtaccacccagatatcttaaccgatgagttcaaaaaggaactagaagggaaaggacagcgagccacagcagccatcttcttgaaccgctacaagatctacacagcagacaacaaggggaccagggaagagaaaaagattcaggcctaccagtggagggttgaggcgcttagccagcccctcgatgtaaaggaggtagcgtacgtcatcgccgaaatcaataacaacctgaataacagtagcggctatctaggggcaatctcagaccgttcgaagaagctctacttcaacggccagaccataggcgaatacttgttcgaggaattgagcgccaacccccacactcgcctgaagaaccaggtgttctacagacaagattaccaagacgagttcgagaaaatctggaaaatccaaaccaaattccatcccgaactcacgaaagaactcaaggagcaagtgcgggacatcgtgatcttctaccagcgcaaactaaagtcccaaaagggactgatcagcttctgcgagttcgaaagcagagagatcgaaatcgaagaaaacggaaagcggaaacggaaaaaggtaggccttaaggtggcaccgaaaagttcgcccctcttccaggagttcaaaatatggcaggtcctaaacaacatagaaatcaaaaacgaggacgaaagaagatacctggaaccagaggaaaaggaactacttttcaacgaactgaactgcaagggcaacctaacctcgcagaaatgcctcgagctcctaggattcaagagcaaagacgccaaactaaatttcaaagtagttgaaggcaacagaaccaacgaaaaactttacgacgcctttctcaaaatactggagcttcaagggtacaacgtcttcgagctcctaaaaataaaagaagataaagacgaagctaaactcagcgaactcaaagcatcggcggatgaaatcaaagggatgatcaaggagatattcaatgccaacctgatcaacacatcgatactcgacttcaatgccgaactggagggaaaagacttcgagaaccaagcctcataccaattctggcacctcatgtacagctacgagggagataattccccctccggtaacgagaaactttatgagctactagaaaagaaattcggcttcaagaaggagcattccaaaatcctcagcacaatcgtcttcagtcaagaatatggaagcctcagcacgaaagccatgcgccgcatatacccctacatcaaagacaacaagtatagcgaggcatgcctacttgcaggctacaaccacagcaaacactcccttaccaaagaggaactcgagaaccgcaaactaaaagaacagctcgaagtactccctaaaaattccctccgcaacccagtagtggagaaaatcctcaaccaaatgatcaaccttgtaaacgcaaccatatcggaatacggcaagctcgacggagtaagaatcgaactcgcgagagagttaaagaagtccgcgcaagaacgcgaagacatggccaagtccatcaatgaagctacattgctgcaccaaaagtacgccacaatactcaaacaggagttcggcgtcgtaaacccatcgcggaatgacatcattcggtacaagctgtacatggaactcacagtcaatgggtacaaagacctatacacgaacacaaagatcgaaaaagaaaacctcttcactgacaaatacgacatcgaccacatcattccgcagagccgcttctttgacgacagcttcagcaacaaggtcctcgtcccacgacagtccaacctcgacaagggaaacttgacggcatacgacttcatgtcaaacaaggggtcagaaagagaggaacatttcttaaacgtaattaaagagctactagacaagggatcgatatccaaggccaagtacgaaaaactgaaaaagaaaggcctcgaaatcggcgacggcttcatcgaacgagatctccgcgacacacaatacatcgccaagaaagcgaaagagatcctctttgaaataaccaactcggtagtaaccaccagcgggagaatcacagataagctccgaaaagactgggacctagtaaatataatgaaggaactcaaccttgacaactaccgaaggctaggcctaaccgagatagtgcgaaattccaaaggcgaagaaaaggagctcatacccgactggacgaagagaaacgaccacaggcaccacgcaatggacgcgctcactgtagccttcacgacccgcaaccacatccagtacctaaactacctgaacgctaggaaggacgaaaaacacaaagaacaccagaacatctacgccatcgaaaatataatcacggaggtcatagaaaagaaaaacggctctaagacccgacgattcaaggcgccgatgaactctttcagacacgaagcgaaacaacacctgaaggaaatactggtgagccacaagaccaaaaacaaggtagtcactagcaacataaataagaccaaaaagaaaggagggatacacaagaaaacagaactgacgccacgcggacagctgcacaaagagacggtatacggctctaagaaattcctacagtcacgtgaagagaaagtatcggcaaaattcgactacgaaacaatactcatggtagtaaaccccatccatcggaacgccctcttaaaccggctcaaagaatatgggaacgaccctaagaaagccttctcgggcaaaaacgccataaacaaaaacccagtctacctcgacgactcgaagacagatatactatccgaaaaagtgaccctatcgtggtatgaaacaggctacaccatacggaaatccgtcaccccagacaactttaaggactataaaaacctagagaaaataaccgacctcggaattaagaagatcctcaaagaacgcctagaccaattcaaaggaaacgcgaaagaggccttctccaatttggacaaagacccaatctggctaaacgaggaaaaagggatcgcaataaaaaccgtaactatcaccggcgtgagcaacgccgagagcctgcacttcaagaaagatcacctaggcaaagagatcctcgacgaaaatggaaacaaaataccaggagacttcgtaagcacgggcaacaaccaccaccttgcaatatacctagacgaagaagaaaaactggacgacaaaatggtcacattctacgaggcggtgcttagagtcaaccaaggcctccccgtaatagacaaagactacaacaaagagaaagggtataaattcctaatgacactaaaacagaacgaaatgttcgtattcccaaacgaggatttcgatcccaacgaaatcgaccttctagacgagcgtaacctggagcgaatctcaaaacacctattcagagtacaaaagatctccaaggtgggctacggcaactccttcgtacgcgacttcgtattccgccaccacctcgaaacgacggtcgaagaacgcaaagaactgcggaacatcacttacatacaactgaaaagcctagagggtctaagaaacatcatcaaggttaggctcaaccacttaggaaaaatagtacaaataggggaatactga

SEQ ID NO: 6779 - RNA, 4215 nt, synthetic construct
  misc_feature 1..4215: note = Cas9 variant
  source 1..4215: mol_type = other RNA
atgacaaagaacatactgggcctagacctaggcgtcagcagcatcgggtgggcgctggtacaagaagactcaaagaacccggaaaacaaccgcattgtcaaactgggcgtgagagtcaaccccctcaccgtagacgagcaaataaacttcgaaaaaggaaagccaataaccaccaacgcgagcaggaccctagcacgatcagcgcgacggaacctccagcgattcaaattcagacgcgcgaacctaatcgatgtgctaaaaaagtgcaatatactgaagcagggcgacctactaaccgagatcggcaaaaatagcacattccaaacccaagagctgcgagcaaaatctgcaaaagaaaaggtggagctcagtgacttcgtccgggtgctactcctcatgaacaagaaacgtggctacagaagcagccgcaaagccaaaaacgaagatgagggacaaataatagacggaatgtcagtcgcgaaaaaactgtacgaagagaacctcacaccaggcgagtactcctaccagctcctcatcgagaacaaaaaacagctgccagacttctaccggtccgatctccagtcagaattcgaccgcgtctggaagtttcaaaaacaatttaaccccgagattttaaccgacgacctctacaaagagctgcaaggcaaaaataagaacgctacctgggcggtacttaaggaaccattcagcttagtggggatcaaacaaataggcaccatacaagaaaaaaaagcggaaaaatacttctggcgctcagaggccgtgaagcgtcaactcgacttcgaaagtctggccgtagtcttccaggaaatcaacagcaacctcaacaattcttctggctacctcggcgccatatcagaccgctcgaaagagctgtacttcaacaatcagaccgtcggcgaatacttattccaacagctcaaggagaactcccacaccaaattgaaaaaccaagtcttctatcgacaagactacctagacgaattcgagaagatatgggagacccaaagcaaatactacaaagagctcactaaggaattaaaggaggaaatccgagacatcataatcttctaccagagaaaactaaaatcccagaaaggattaatctcaatatgcgagttcgaaaaccgggaaattgagatcaccgagaacggaaaaatcaaaaaaaaaaccgtaggcctcaaagtagccccaaagtcctcaccactcttccaagaattcaagatatggcaagtactaaacaacctagtgttccagagcatcgaatccaaggagctattcccactcgacctagacatcaaagaatcgatattcaatgaagtaaacataaaggggaacttatccgcaaaaaacgttctggaccttatgggttacagcgggaaggagtggaagactaacttcaaaaacatcgagggaaaccgcactaacgaaaacctatacaccgccttcctcaaaataatcgccagtgaggggatcgaattcccgaaggaattcaaactgtcaatcgacgacgacatcaaggtctccaaaatcgacatcagctcggaaaaaataaaggagtttataaaagaaaacttcctaaaacttggaatcaatacaagcatactcgactttaaccccgaactagacggaaaagactttgagaagcaagaatcctatcagctgtggcacctactgtattcctacgaaggcgacgactccgcctctggcaacgtcaagttatacgaactactggagaaaaaattcgggttcaagaaggaacacagcaaaatcctcgcagacgtgggcttctcccctgactacggcagcctaagctccaaagctatgcgcaaaatctacccatacatcaaagagaacaagtactcagacgcctgccacctagctggctacaaccacagcaaaaacagcttcacaaaggaccaactcgctaacaggatactcaaggaacaactagaaatactacccaaaaatgccctgcgaaaccccgtcgtagaaaagatacttaaccagatgatcaacctagtcaacgaagtaatcaaagcgtacgggaagccggacgaaatcagaatcgaattggccagggagctcaaaaaaaacgcggaggaacgggctaacatgacctcggacatatcaaaagcaacactacttcaccaaaagtacgccgaggtattacaaaaagaattcggaatcaaagccccgtcccggaacgacatcatccgttacaagctatacctcgaactcgagaaaaacctattcaaggacttatacacagacgtacagatcaagcgagaagagctcttcacagacaaatacgacatcgaccatataatacctcaaagcagattcttcgacgactccttcagcaacaaggtactagttccgcgaggcgcaaatctaaaaaaagggaacttcacggcactagattacatggagatcgagggcaaagagaagttggaaaagttcttaaacataataaaagaactcttcgataagggcgcaatcagcaaagcgaaattcgagaaactccagaaaaagggatccgaaataggcgagggcttcatcgaacgcgatctccgtgacacccaatacatagcgaaaaaggcgaaagagatacttttcggtataacaaactcggtcatctccacctcgggtaggatcaccgacaaactacgcgaggactggaacctagtaaacaccatgaaggagctaaacctcgagaagtaccgcaagctcgggctcacggagctaatcgtcaattcaaaaggcgaagagaaagaacgaataatagactggacgaaacgcaacgaccacagacaccacgccatggacgccctcaccgtggccttcaccacgcacaaccacatccaatacctcaactacctgaacgccagaaaggacgaaaaacacaaggagcaccaaaatatcttcgccatagagaacacaataacggagatcgtcgaaaagaaaaatggatccaaagagaggagatttaaactcccaataaagaacttccgcacagaagcaaagaaacagctagaggaggtcctaatctcccacaaggcgaagaacaaagtcgtgacaaaaaacataaacaaaatcaagaaaaaagggagcatcatagctaagacggaactcacgccccgcggccagctgcacaaggaaacgatatacggtagctcaaaattcctcaaaactaaggaagaaaagatcagcggcaaatttgatctcgagatgatacagaaagtccaaaacgagaaataccgcaatgcccttctcaaacgcctgcaggaattcggaggcgactctaagaaagcattcacaggcaaaaacgtcatcagcaaaaacccgatatttctcaacgcagagaaaacggagcaactcccggaaacagtcacactggcgtggtatgagacaggctacaccatacgaaaagtcgtaaaccccgacaacttcaaagattttaaaaatatcgaaaaggtcatcgacaagggtgtaagggacattctgaccgaacggctcaaagaattcaacggcaactcaaaggaagccttctcgaacctagaaaaaaacccaatatggctgaacaaatcaaaaggcatcagtatcaaaaccgtcaccatcaccgggataaataatgcggaggcgctccactataagaaggaccacctaggaaaggagatcctcgacgagaatgggcaaaggatcgcggtagacttcgtcagcaccgggaacaaccatcacgtcgccatctacgaggacgacaatggcaacctccaagagaaggtagtatccttctatgaagccgtggagcgggtaaaccagaatctccccattatcaacaaagaatacaacttcgaactcggatggaaattcctattcacaatgaagcaaaatgagatgttcctgttcccgtcagatgactttgacccgaaagaggtggacctgttcgacgataagtacctatcactaatctcgaagaatctgttcagagtccaatccataagcatcgtccagtacggcaacagcgtgatccgggatttcaaattccgacaccacctcgaaacgagcgtgagtgacgagaaaaaactccagggggtgacctaccaacaaatcaagtcactacaacccttaaaagacataatcaagatacggcttaacaacctggggaagatagtacagataggggaatactga

SEQ ID NO: 6780 - RNA, 4215 nt, synthetic construct
  misc_feature 1..4215: note = Cas9 variant
  source 1..4215: mol_type = other RNA
atgaaaggaaacatcgagaaaaagaaacaggagttcaacgactattatttaggctttgatatcgggacgaactccgtaggatgggcagtctccgacctgtcctacaacctcctacgctttaacaagaaagacatgtggggagcccgactctttgacgaagcgaaaacggctaaagaccggcgcgtcaaacggaactcgcgccgccgactggaacgtcggagcaaacgtctcaaatacctcgaagaaattttcgaaacggaaatatgcaaaattgacaaaaacttcttccgccgactagaagaaagcacgctgcacaacgaagacaaaacgtttgacttccgattccccatatttaatgacgaaaactacactgataaagaatactacaaagacttcccaactgtctaccacctacgcaacgaactcatcaaaaatgaaaacaagaaatttgacatccggctcatatacctggccattcacaacattctcaaatatcgagggcacttcatcttcgaaggtcaagacttcgacagcgtcaccgacttcaaagaagttttctcggaactatcagcatacctgagcgaaaacctagaagaaaacctagacatcaacctttgcgataacatcaaagacatcatctgcagtaaagaaaacaaaacatcaaaaggaaagagcttcgtttcgctaattgactcaaaagtcatacaatcagtcctgagatgctgcatagggtaccgagtcaaattcaaagacatcttcatcaactacgaagaaaaagaaaagaacgaagggatcaacctatccgaaatagaatacgatgaaaaacgcgacgaaatagcgctcagcctcggagaaaacatcctcctaatagatatatgcaagaaggtgtacgacttcatgatccttaataacattctcaaaggaaataaatatatatctgaaagcaaagttaatctttacgacgaacacaaatgcgacctctgcaacctgaagtacattttcaagaaatacctgccgaagaaagattatttcgagttcttccgcaacgaaaataaggagaagaactacgtatcttacataagctctagcctcaacaacggcaagaagaaaaatacctgtacgcaagaggacctaaacaaggaaatcaaggaatatatagccaaaatcaaagaatacgaggagaatgacgccgtcctagaaaagataaacctaaaactaaacgagaacaaactactccccaaattgaaaacaaatgacaacggagtaatcccatatcaaatacacaagatagaactagagaaaattctccagaaccaaagcaaatattacgatttcctcctcgagaaaatcgacgggataacaaacatcgaacgcatagaaaaacttttcacattccgcatcccctattatataggcacgctgaaaggcaaattcagctgggccaaactcaaagagaacaaaaagataaccccctggaacttcgagaaaatcgtcgacatggaggaatcggcgaaggctttcatagaacggatgtccaaccgctgcagctacctcaaaacagaaaacgtcctgcccaaaaactccctattgtactccgaatacgagctcctgaatgaactgaacaaagtcaaaattaaaaatgagtttataaacgtagtactcaaaaacgaaatcatcgacgaactcttcaagacgacgtccaaagtcacgaagaagaagttcgtcgactaccttaagacaaaacaaatcttcgtggagaaagaagatatcagcgggctcgacaacgagttcaaatctaagctagactcttacatcaaattcaagaaagtcataggggacaagatcgacacactcagaggttacaacttcgtcgaaaagtgcatcgagttcaagtgtttctacggtgacgacaagaaactcttcaagaacgcgataaacaacacggagttcaaagactacgttagcgacgacgagctcaagaagatcaacaagatgaaattcaacaaatggggacgcctaagcaaacgcctactaacggaaatatgcttcgaaaacgtaatagagtcagagagcttcgagaacatcatcgtggccctgagaagcaccaactacaacttcatggagttcacatccaagaaattcaatctatccgagaaggtcgcggaagaaaatcaagaaaatacactggaaaagttcaacataaacgagtacgtggacgaactctacgtgtcgccatccgttaaacgatccataatacaaacttacaaaatagccatggagatcaagaaaataacgggcaagaaccctaaaaagatattcatagaaatggcccgcggcggaggcgagaaaggcaagaaaaccgaaaaacgcaaagaacgaataaaaaccctgtacgcgaatatgaaagatagcaacgaggagttcctgaacaatctcgataacctgaaattgtccgtggacaactatgacgacaaccgtctccgagagaagaaactgttcctctatttcatgcaactcggaaaatccatgtataccgggaaaaatatagatctcaacgagctcctattcgcaaatacgtacgacatagaccacataatacctcagtccaagctaaaggacgacagcttcgacaacatcgtcttggtcgagaaaacgataaacaaagacaaggacaaccgagactacctcgacgagtcgattagactccgaatgaacaaattctggaacttccttcgagagaagggcttcattaccatagaaaaatacaaccggctccgtaggaacacctacttctccgatgacgagctcagcggcttcatctcgcgacaactggtgaccactcgacagtcaaccctcgaagtgaaaaagctatttgagttcatcttccagaatacagacgtcgtgtgctccaaagcaaacttggtatccgacttcagggagaaatacggcattataaaagtaagagacctcaacgacgcgcaccacgcgcaagacgcgtatctaaatatcgtggttggcaacgtattcgatactaagttcaccaagaattactggaaattcatcgaggaccggcggaaggttgacaacatacgcgaaacgtacaactttaagaaaatattcgactacgatgtcagccgcggcgaaaacgttgcatggctcaaagactacagcataaacacaatctccgaaatgatcaataaaaagaccgccaacattacccagatgatcacagaaggcaaaggacaacttttcgacctcaccattttaaagaaaagcaaaatagacaagaagctgacggtcatccccaacacaccgaaaatactcaagagcagtctcaaagacagctgcaagatagccgagaaatacggctacttcagcaccctgatgccggcctacttcgtagtattcaagtatatcgacaaaaacaaggaagttttcggattcgacagaatcttcatcttcgaccgcgagaaaattaacagcaacgaggatatagaaaaatacttagaagataaaggctacaattccccaaaatttattcgtaaagtgaacctgaaacagaagatcctcttaaacgggtacccatacagaatagttggattcaccgacaacaagctggagattaagaacagcaaacagttctacagcgacggggaacacctcaagtatataaagcacttgagcgcattctacaacaacaacaataacgtgaaaaacggcgaataccgaattaactttctaaagaaaacttcagagaacgaccgaaacgagacgactgatgaagcaaaggaacgcctgaacatcgagttcattaaactttacgaatacttctgcgagcgcctcaactctaaaatctacgccaactactataacagcaagaaatacgacgaactcatagaggtcttcgactgcttcaagaatctaaacctactggacaaagctaagctcttgctggagttcctaaaaatattcaagaaagacacatatggcaatttcaaactgctcgagaagccagaactagacaaaaacggcaaacaaaagctagacaagaacggcaacctcagctttgagggcttgagtatggccttcggcaaactgaacggaaagaaattcaaacagctagtggagaaagacatccaattcgtagacgaatccgtgaccggcttgttcgagaagaaagaaggactcgaaaaatggcaggacggagagcaatga

SEQ ID NO: 6781 - RNA, 4215 nt, synthetic construct
  misc_feature 1..4215: note = Cas9 variant
  source 1..4215: mol_type = other RNA
atggccaagaaaatactcggactcgacctaggcgtctcatcgatcgggtgggctatcgtggaggaagacgccgagaacgtcatgaacaacaaaatcgtcaaactcggggtccgagtcaaccccctaacagtcgacgagcaaataaacttcgaaaaaggaaaacccatcaccacaaacgccggccgtacgctcgttcgaggggcgagacgcaacttacagcgcttcaaactgcggagactgcatcttatcgacatcctgcaaaaacgaaacatactaaagcaagccgacctactcgcggagagcggacgaaacagcaccttccagactcaagagatccgggcaaaatcggctaaacaaaaggtcgaactctccgagctggcccgagtactcctcctgatcaacaaaaagcgcggctacaaatcatcacgaaaagcgaagaacgaagacgagggccagatagtcgatggcatgtccgtagccaagaaactttacgaagaaaacacaactccaggagaatactcatatgaactgctcaaaagtggaaagaaacagcttagcgacttctaccgctcggacctacaagccgagttcgaccgcgtgtggaacttccaaaaacaattttaccccgaaatcttctcggacaacctatacaaggaattgcaaggtaaaaacaaaaatgcgacctggaaaatcctggaaataccgtttagcctggtgggtataaagcaagtaggcaccacccaagaaaagaaaatagagaaatatttctggagatctgaggctgtaaagaaacagctcgacttcgaatccctggcagtcgtatttcaagaaataaacagcaacttaaataactcctcaggatacctcggtgcaatcagtgaccgctccaaagaactctactttaacaaccaaacagtcggggagtacctgcactgccaactaaaagaaaatccccacacgaaactgaaaaatcaggtcttctacaggcaggattacctcgatgaatttgagaaaatatgggaaatccagtcgaaataccacactgtactcaccaaagaactaaaagaagaaatcagagacgtcatcatattctaccagcgtaagctcaaaagccaaaaggggctcatcagcatatgcgagtttgaaaacagagagattgaaatcaccgagaacggcaaaatcaagaagaaagaagtcgggctgaaagtagcaccaaagtccagcctcctttttcaggagttcaaaatttggcaagtcctcaacaaccttcaattccagaacattgaaagcaaggaaatattccccctcgacctagactgcaaagagagcatcttcaacgaagtcaacataaaagggagaatcagcgccaaagcggtgctagacgtcctaggttactcaggcaaggaatggaaaacaaatttcaaggacatagaaggaaacaacagcaacgagaacctctacaacgcatacctaaaaattatagcaaacgaggggatcgaatttccaaaggagttcaagtgcaacctcgacgacgacatcaacgtctccaaaatcatatgctccgccggaaaaatcatcgaatttgtccgcgaaaaatttagtgaattgggcatcaacaccagcatcctcgacttcaacagcgaactagaaggaacgaacttcgaaaaacaaaagtcctaccaactctggcacctcctgtactcatatgacggcgacgatagccccagcgggaaccaaaaactatacgagctactcgaaaagaagtttggattcaagaaagaacactccatcatcctggcagacataggtttcccgcaagaatacggctctttatcaacaaaagccatgagaaaaatcatcccccacctcaaaacaggccttccctttgcaaagaaaagcgacaacgataccatactatccgccaccgccatggcaggatacaatcacagcaaaagcctgaccacagaagaactgacaaaaagagtcctaaaagaacatctcgaaatcctccccaaaaacagccttcgcaacccagtcgtcgagaaaatactcaatcaaatgatcaatgtagtcaacgaagtgatcaaagaatacggaaagcccgacgaaatacgcattgaactagcacgagaattgaagaaaaatgctgaggaaagagccaacatgaccagcgaaatcggaaaggcaaccatccagcaccaaaagtacagcgaaatactccaaaaggagttcggcataaagtccccgtcccgcaacgacatcatccgctacaagttatacctagaactgagcaacaacggctttaaggacctatacacagatatacaaatcaaacgcgaagagttgttcaccgacaaatacgacatagaccacatcatcccgcaatcccgcttcttcgacgactccttctctaataaagttctggtgccgaggggagccaacctaaagaaaggaaacctcacagcgttcgattacctagaatctgagggcaaagatacgctcgaaaagttcatcaacaccattacggagttctatgacaagggcattatcaccaaggcgaagtatgaaaaactacagaagaaaggcacggaaatcggcgacggcttcatcgagcgggatctccgcgacacacaatacatagccaagaaagccaaagaaatccttttcggcatcaccaactccgtcgtaagtacaagcggaagaatcacagacaaactccgcgaggattggaacttagtcaacacgatgaaggagatgaacctcgaaaagtatcggaaacggggactgactgaaacagtcataaacagtaaaggtgaagaaaaggagaaaatcatagactggagcaaacgcaacgaccacaggcaccacgccatggacgctctcaccgtcgccttcacgacccacaaccacatccagtacctgaactacctcaacgcccgcaagaacgaagaccacaagcaacacaaagtaatttccaacattgaaaacctgatcacaaaagtctttgaaaagaaaaacggaagcaagcaaaggcgcttcctggaaccaatacacaatttccgcatcgacgctaagaaacacctggaagagatactaatttcacacaaagccaaaaacaaagtagtgaccaaaaatataaacaagataaagaagaaaggaagcatcatagcaaaaatcgaactaacaccccgaggacaactccacaaggaaacaatctacggatccagtaaatacctaaaaaccaaagacgaaaaactatcgggcaagttcgaccttgaaaccatcaacaaggtacaaaacgagcgctacaaaaacgccctcctcgagcgactgaaagtcttcgggtacgacagcaaaaaggcttttaccggcaagaacatcctcgcaaagaaccctatcttcttgaacatagagaaaacggaacagcttccagaagtcctaaccctagcctggtacgaaaccatatacaccatacgcaagtcgataaactcggacaacttcaaagactataagaacattgacaaagtcacagataagaaagtgcacaacatcctcacagaccgactgcgcgaatttaatggaaactcaaaagaagccttctcagacctggagaaaaaccccatctggctgaacaagccaaaaggcattgcaataaaaaccgtgacgatcaccggagtaaacaatgtggaagccctccactacaaaaaggaccacttcggaaaggaatttctagacgaaaaaggccataaaatccccgtcgatttcgtgagcaccggtaacaaccaccatgtagccatctacgaggacacggccggcaacttacaggaacgggtcttatccttctacgaagcggttgaacgagtaaaccaaggtctgtctgtaatcgacaaagaatataattcatcgctaggatggaagttcctcttcacaatgaagcagaacgaaatgttccttttccacagcgaagacttcaacccgcaggagatcgacctgtacgacgagaaaaacttgcgcctcatcagcaaaaacctcttcagagtccagaaattcaccgtgaaggactacttcttccgccaccatctcgaaacgaacgttgaagataactccaagctaaaaggcgacacctggaaacgcgaagggctaaacggcatccgcggcatactaaaggtccgactaaaccacctaggcaaaatagtccaagtaggcgagtactga

SEQ ID NO: 6782 - RNA, 4215 nt, synthetic construct
  misc_feature 1..4215: note = Cas9 variant
  source 1..4215: mol_type = other RNA
atgagcaagaaaatcctgggtctcgatctagggaccactagcatcgggtgggcgttcgtgcgagaggcggaagacttccaagaagaaagcagcatcgaacgaataggagtacgcgtcaaccccctcacgacagacgagcaaatcaacttcgagaaaggcaaacccatcagtgtaaacgcagaccgtaccctcaaacggggcgctcgtagaaacctccagagatataaacaaaggaggaccaatctcatacagctactcaagcagtacaagataatcaatgaaaacacaattctcgcggaggacgacaaaaacacgacccactccacatacgccttgagagccaaagctgtcagcgagaaaatatccaaggaagcattcgcaagagtcctactcatgatcaacaagaaaaggggctataaatcaagccgtaaggcaaagaatgaagacgagggacaagcaatcgacggaatgagcgtagccaaacggctgtacgaagaggacattacccccggacaattatgccttcaactgctcaaagaaggaaagaagaagctaccagacttctacctatccgacttacaagcagaactagaaaagatctggaacttccagaagaaattctaccccgaaatcttgaccgacgagttcaagaaagagattgagggcaaaggtcaacgtgccacatccgcctcattctgggccaaatataaatttaacaccgcagagaacaaaggcagtagggacgagaagaaaatgcaagcctgggaatggaggtctaaagcaatcaacacccaattaacccgtgaggaagtagcctacgtcataacagaaatcaacaacaacatcaacaactcgagtgggtacttaggcgcaatatcggaccgcagcaaagaactatacttcaacaaggaaactgtgggggagtacctatttcgccaactgcgctactcaccccacacccgtgtgaaaaaccaggtgttctaccggcaagattacctagacgagttcgaaaccatttgggaaaaccagtcacgctaccacaacgagctaacgaatgagctcaaaagtgagatccgagatgtcgtcatcttctaccaaaggaagctcaaatcccaaaaaggactcatctcattctgcgagttcgaaagcaagcaaatcgaaatacagaaagacggcaaaatcgtcaagaagatcatcggcctcaaagtctccccaaaatccagtcccctcttccaagagttcaaaatctggcagatactccagaacttggagttcaccaacaaggaaaccaaggagaaaaaggtgccagattttgaagccaagaacctcctcttcgaggaactcaatatcaaggggaacctaaagggcgaaaaagcaatcgaaatactaggctacaaacccaaagagtggctggtaaactacaaggagctcgacggcaaccgaaccaaccaagtcctctatgaaggctacctcaaaattctagaggtggagggctatgacataaaagaccttctcaagataaagtccaacaaagatgaagtcaacctctctgagcttagcaagcccgttagtgagatcaaagacttgatcaaaagtatcttcgaatcgctaaatataaacactgcaatcctcgacttcaacccggagctcgagggaaaagatttcgagcggcaagccagctaccaactatggcacctcctatactcctacgagggcgacaactccaacactggcaacgacgaattgtaccgactcctataccaaaaatttggattcggcaaagaacacgcacagattctagcaaacctctccttttcccaagactacggctcgctcagcgcgaaggcaatgcgcaagatctacccctttataaaggaaaattcgtactccgaggcatgtagcttggccgggtacaaccactcctcatccatcacaaaggaagagaacgataaacgggagctaaaagaaaaactcgaactcttacccaaaaactcgctccgcaaccctgtagtcgaaaagatcttaaaccagatggtgaacgtaataaatgcgattatagctgacccaagcatgggtagacccgacgaaatcaggatcgaacttgcacgcgaactgaaaaagaacgcggcggagcgagcagaaatgaccatacacatcaacaaggccaaatcggaacacgacaactaccgtaaaatcctaacaacggagttcggcatccccaaccccacgcgcaacgacatcatccggtacaaactgtacgaagaactgaaagtcaatggctataaaacgctgtacagtaacacgtacataccccgggaaaaacttttctcaaaagagttcgacgtcgaacacatcatcccaaaagcactattgttcgacgactccttctcgaacaaaacgatatgcgcacgccaggaaaacttagacaagggcaacaagaccgccttcgactttatacagtctttctacggcaaggaaaagttcgaggagtacctccagcgaatagaatcactggcgaaaatcaaagagggcgacaccttcgtgatttcgaaagctaaatataagaaactcctcctgccggaaatcgagataggcgagggattcatcgaacgcgacctgcggaactcccagtacatcgcaaagaaagccaaatccatgctcctagacatctgcaaaacggtcgtcccaacaaccggatccataactgacagactacgagaggactggggcttaatcaacataatgcaggagctgaactttgaaaaatacaaaaagctaggcctgatagaaatggtcgagaagaaagacggcagcttcaaagaacgaatcaccgactggacgaaacgaaacgaccatcgacaccatgcgatggacgcgctcacggtggccttcaccaaacacaatcacatacagtacctcaactaccttaacgcccggaaaaacgaaaaccacaagatgcatggcaatgtaatcgcaatcgaacaaaaagaaaccgaactactcgtagactccgtagggaaaagaaaacgtaagttcaaactgcccataagcaacttccgagaggtcgcaaaaatgcatctagaaaacatactcgtatcctacaaggccaaaaacaaggtcgccacgaaaaacaaaaaccgattcaaaaccaaaaacggagagaaagtaaaaatcgagctcacaccccgaggccagctccacaaagagacggtgtacggaaaaatgaagaagtacgaaacaaaagaagagatcattgggtcgaagttcgacgaggcaacgatactcaaagtggcaaaccttgaacaacgcaacgccctcctccaacggctcaaagaaaacaacaacgaccccaaaaaggcatttagcggcaaaaacagcctgaaatcgaatccactctactacggagtcgacagcaagcccatacccgaaagaataaaaatagtctggctcgaagacgattacactatcaggaaagaaattaccccagatttaaagatagacaaggtcatcgacatcggaatacgacgaatactagagaaccgtctagcggagttcaacggcaacgcaaaagaagcattcagcaacttggagaaaaacccgatctggctaaacgagggaaaacgcatagcgatcaaacgagttaccatcagcggagtcaaaaacgccgaaaccctacattacaaaaaggaccacctagggcatgagatgctcgacaagcagggcaagcgcatcccagttgacttcgtgagcaccggaaacaaccaccatgtagcaatctacaaagacgataagtccgacctccaggaaaaagtcgtcagcttctacgaggccgtagaacgcatcaaccaggagctcccgatcatcgataagtcattcaatcacgacttaggatggcaattcctgttcaccatgaaacaaaacgagtacttcgtgttcccccgcgatggattcgacccctacgagatagacctacttaaccctgacaactacaaaatcatcagccccaacctcttccgagtccagaaaatagccaccaaaaactacgtcttcaatcaccacctagaaacaaaagccgtcgacggcgaacttctcaaaacgaaaaaggacctctcggacatcacttaccggttcatccaaacacccgtcaatctgaaaaacataataaaagtcagaataaatcacatcgggcaaatcgtgaaaataggcgaatactga

SEQ ID NO: 6783 - RNA, 4218 nt, synthetic construct
  misc_feature 1..4218: note = Cas9 variant
  source 1..4218: mol_type = other RNA
atgaaaactatactgggactcgacctcggcacgaactcgatcggttgggcgctagtcaaagaagccgaaaactcaaacgaaaaatcagaaataatcaaactaggcgtccgagtcaacccactcacggtcgacgagaaaaccaacttcgaagccggcaggccactatccacaaacgccgaccgtacagcaaaaagaagcgcgcggagaaacctgcaacgctacaagttgagacggaaaaatctcattgacctccttataaagaaccaactaatcgacaaagacacaccactgaccgaaatcgggaaaaacacaacacaccagacgctggaactgcgagccaaggccgccagggagcgtatcgagcttgaggacctggcccgcgtgttcctcgcaataaacaaaaagcgcggataccgatccagccgaaaagtcaacaacgaagaagaaggacaagccgtcgacggaatggcagtagcgaaaaagctctacgacgaaaacctaaccccaggacaatacgcctacgagctactatccaaaggcaaaaagtatgtcccagacttctatcggagcgacctccaggcggagttcaacgccatatgggaataccaaaaacaattctacgccgacatcctagacgacgagctttacaatgccctgaaagggcaaggccaacaaaactcgcgaaagagattcctcgccatcaaaggcgtctacactgccgagaacaagggcaaaagggacgacgtgaaactaagacactacaagtggagatccgaggcgatctccaaaaagatcaacatcgaggaggtcgcctacgtcctagttgaaatcaacaacgacctcaacaagtccagcggatacctgggcgcaatatcagaccgatcaaaagagctctacttcaacaaggagaccgtaggcgaaaacctgtggaagcaaatccagaaaaacccccacaccagccttaaaaaccaagttttctaccgtcaagactatttagacgagttcgaacagatctgggaaacccaagcccaattccacccacagttaaccctggcactaaaggagcaaatccgcgacgtcataatcttctaccaaaggaaactcaagtcccagaaaggtctgctctccttctgccagtttgaaagctgggaaatcgagaggaaagacgagaacgggaacgtcattctcaataagaccactcaactccccaaacgccagaccgtaggccgccgggtcgccccaaagagctcaccgctattccaagagttcaaaatatggcaaaacattaacaatttggaagtgacaaaaatcagcgaaggcgcatcaaagaacaagaaagaaactgaaaccctctcggatgatgaacgaaaacttctgtttgaggaactaaacctcagagggaacctcagccagaaggaagtccttcaaatactgggcttgaaagacaaggaatacaaaaccaacttctccgaaggcctggaaggcaaccgaacaaacgcggccctattcaacatctaccagcaaatagccgaaaacgaaggctacggcttcgattggtcaaagaaatccgcacaggaaataaaggaagaactaaaggccgtctttccgcagatcggcatacaagccgacattctagacttcaacgccaacctagacggcaaagagttcgaaaaccaagcctcctaccaactctggcacctcttgtactcagccgaagaagacgacaaaattaacgaagaagaccaaatcatttacggcaactcagcggtgtcccttaagaagaaactgtgcgagaagttcggattcacacctgaatacgcaaaatggatcgccaacgtatctctacaggacgactatggaaacctgtccactaaagccatgcggaaaatcataccgtacctaatagacggcaacgactattcagaagcatgcgccctcgcgggatacaaccacagcaacagcttaactaaggaggaaaacgacaatcgtgaattgctcgataagctagagctactccccaaaaactccctacgcaacccagttgtcgagaagattctaaatcaaatggtaaacgtcgtaaatcaggtaattgagacctacggcaaacccgacgaagtccggatagaactcgctcgggaactcaagaaatcggcagaaaaacgcgctgaaatgaccaaatcaattaacgaggcaacccgccgaaacgaggacatcaagaaactcatcacaaaagacttcggcatcccaaaccccacaaaaagcgacgtagtaagataccgcctctgggaagaactagcacccctcgcatacaaagacgtcttcacaggcaaacagatcaaaaaggaagacctgttctcaagcaaaatcgacatcgaacacattatccccaaagcattacttttcgacgactctttctcaaacaaaacgctcgtcttccgggaaacaaacttaaagaaagccgaccgcaccgcgtacgacttcatagaatccgactacaacgctacactcgacgactacatccagagggtcgaaaccttgtataacaacacaaaagggacgatatcgaaaggcaaacgcaacaaactacttatggcacagaaaaaccttcccgacggattcatcgagcgcgacctacggaacagccaatatattgcaaagaaagccaaagcaatgttatatcaagttttcaaagacgtcaacgtcacgtccggcagtataaccgatcgactccgagaagactgggacctcatcaacgtaatgaaagaactaaactttccaaaatacaaagccctcggtctcaccgaaatagaagaacggtacgacatcggccaagagaaaactaaacgcgtcgaagtcatcaccgactggaccaaaagaaacgatcaccgacaccacgccatgaacgccctcacagtcgctttcacaacatccagccacatccaatacctgaactatctaaatgccaggaaaaacgaaagtcacaaagaacacaaaaacataaaaggcatcgaaaacaaaattactcacaaacagaaagacaagagaaaattcatccctccaatgcccaactttagggaagaagccaaaaagcacatagaaaccatcctggtctcgatcaaaaacaaaaacaaagtctacacgaaaaacatcaacaaaacaaagaagaaaagcgggcacaacaccaaagagcagctcacacccagaggacaactccacaaagagacagtgtatggcaagtcgaagagacccatgtcgaaaccaaccaaaatcaacaagaacttcagcttggaacaagcccaattgatcataaacgtgcaggagaaagagctagtactacgccacctcgcgcaattcgacaataatccagcggtcgcattcgacacaaaaacgcttaaaaagatgcccctactcaaaaacggagaacccctgaaagaagtcctttgcttcgaagaaattttcacgatccgaaaagatataacccctgacctcaaaatcgaaaaagtagtcgacgagaaaatcaaggcgatcctagagcaacggaagaaagacttcggaggcaacgccaaagaagcgttctcggacttggacaaaaacccaatctggctcaacaaaaagaaagggatctgcatcaagcgcgttaccatcacaggtgtttccaacgcggaagcactccaccaccaaaaagaccatctcggccgcgagattctcgacgacaatgggaacccaatcccagccgactttgtctccaccggcaacaatcaccacttggccgtgtacctagattccgaaggcaaacttcaagacaatatagtctcgttctacgaagccgtcgtacgcacctcccaggggctccctgttgtcgacaaaggactgaataaagacctcggatggaagttcctcttttcactcaagcaaaacgagatgtttgtattcccaaacgatgacttcgatataaacgacttcgatctcctcgatgacaagaaagcggaactcatcagcaaacacctctaccgcgtccagaaaatctcaaaagtctcggcaggaaactcattcgtgcgggacatcgtcttccgacaccatctcgaaaccaccgttaaagaagttaaggagctaaaagatatcagctatatccaattaaaatcgctcgagggactccgaaacatcaagaaagtccgcataaaccacatcggcaaaatcgtccaagtcggagagtactga

SEQ ID NO: 6784 - RNA, 4221 nt, synthetic construct
  misc_feature 1..4221: note = Cas9 variant
  source 1..4221: mol_type = other RNA
atggagaaaaagataataggaatagacctgggagtcaccagcatagggtgggcctacgtaatcgaagacgagaatggacattcgcggatcctcagaatcggcactagagtcaacccccttacaacggaagaactgaagaactttgaacagggaaaaccgatcactgagacagccgaacgcaccctcaaacgctctatgcgccgcaacctacaaagatacaagcaacgacgcactaacctaatcaacgtactactgaagaacaaactcatcacagaaaccacggcactcgccgaggacggcaaaggcactacgcacctgacacacgcgctccgcgccaaggcagcgtacgcacagataccactcgaggacttcgctcgtgtactcctgatgctgaacaagaagcggggatacagaagctcgcgcaaagtcaagaccgaagccgacgggcaggccatcgacgggatggccgtcgcaaagaaactctacgaggagaacataacgccaggccagctatgttacaccctccttctacaaggcaagaaaacgctccctgatttctaccgctcagacctccaggtcgaaatggaaaaagtatggacctttcagaaacaattccatcaggccatcctgactgacgagttccggaagtatatcgcgggaaagggacagcgagccacagcagcatccttctggggaaaatacggattcaacacggccgagttcaagggctcacgagaagaaaagaaactaaaaagctacgaatggcgcagccaggcgatcaccaccccgttaagtcaggaggaggtcgcagcggtcatcactgatatcaactcaaacatcgccaacagctccggctaccttggagcgatctcagatcggagcaaagaactcttcttcaacaaacaaacagtgggccaataccaatacaatctactacaacaaaacccgcacacaaatctatcagggcaagtattttaccgccaggactacctcgacgagttcgaaacgatatgggagacccaagcaaccttccacaccatgctaacaccctccctcaaagaggaaattagagacatcgtaatattctaccagcgtaaacttaaatcgcaaaagaaattagtctcaatatgtgagttcgaaaaacgcatactcgaaccactccagggagacaaggtcgtggggtacaaagtggcccccaagtcgagccccttgttccaagagttcaagatctggcaggccctaggcagaatggaaatacaacacaaggtcacaaaagaacgccacttcctcgatctagacgcaaaacaactactattcgacgagctaaatgtcaaaggtgacctaaccaaagaaaacgcactcaccatcttaggattcaagccaaaggaatgggagtgcaacctgcttaaactcgaaggcaaccgaactaaccaagcactctacgaggcctatctaaaaatacttgagctcgaagggtacgaagtcaaggacctactaggactcaagctggacaaggacgacataaagctatccgaactcccagtcgatgccgctgacataaagaagatggtccgggagatcttcgagacgctaaacatcaaaacatcgctactcgacttcaacgcaactcttcccggaaaatctttcgaacagcagcatgcctaccaactctggcacctcctatacagctacgaaggagacaactccccgtcaggaaacaagaaactccaagacctcctccaagctaagttcggtttcacaaacgcccacgggcaaatactggcgaatgtcagcctagagaccgactacggatccctcagcgccaaagccattagaaaaatctttacacacatcaaagaaaaccactactctgccgcctgcgcgctagcgggctacaaccactcaagctacctgtccaaagaagaaaacgagcaacgcatcctcaaagaccgactaacaatactaccgaaaaattcgctgagaaacccggtcgtagagaaaatcttaaaccaacttataaacctattgaacaccatcttcgacgacccctatctcggaaaacccgacgaaataagaatagaactcgctagagagctcaaaaagaatgtccaagagagacaaaggctaaacaccgagataaccaaaaataacacagagcacgaacgcataaccaagatactaatcaaagaagacaatatcaaaaacccgacccgaaacgacataatccggtacaaactataccaggaactgaaacacaacggttataaaaccctctactccaacacctacattccgagggaggagctattcggcaaaaactttgacatagaacacattattccccaaagcatcctcttcgacgacagctttagcaacaaaacactgtgtgtcagaaaagaaaacatcgacaaagcagacagaaccgcaatggatttcatcggaccgtactttggagaagacaaggtccaagaatacatcaatagagtagaaatgctgcaccagataaacctaaagaacccagaagaaggaataggcaaaggcaaatacaagaagctcctcatgaaggcctcggagatcggacaggggttcatcgaacgtgaccttagagacacccagtacatcgcaaagaaagcccgccaaatgctcctcgaagtaacacgaaccgtcgtcgccacaacagggagcatcaccaaacgactccgcgaggactggggactcgtgaacgtgatgcaggaattgaacatggacaaatatcgccaacaaggacttaccgaactaatagagaagaaagacggttccacaaaagaacgcataacagactggacaaaacgcaacgaccacagacaccatgcgatggacgcgctcaccatcgccttcacaaaacactcccacatccaatacctgaacaacctaaacgcgcggaaatccgacgacaagaaagggaaagaaatcttcgggatagagcagaaagaaacagaaaaagtcaaagacgacacaggccaaacgcaacgccgcttcaaactgccaatgcccgacttccgccaagccgcaaaacaccacttagaacaccttcttatttccttcaaggccaagaacaaagttttcacgaagaataagaacaaatacaaaaccaaaaacggagagcaagtcaagctagagctcacgccgcgaggccagcttcacaaggaaaccatttatggacgcatcaagaaatacgtgacacacgaggagaaagtaagcagcaagtttaatgcgcaactaattcaaacagtcgccaactccaaataccgatacgcccttctcaagcgcctagaagaaaacggaaacgaccccaagaaagcgtttacaggcaaaaactctctcgacaaaacacctctattcgttgacgcaacccaacaggagaaaatcccgcccgtggtcaaattggtctctattgaacaagggtatacaatccgcaaagatatcacccccgaaaactttaaagatgcgaaaagtatagaaaagatcgtcgacgtcggaattagaaacctactgcaccataggcttgaaacctacaacggcaatgaaaaggaagccttctacaacttggacaagaaccccatttgggtaaacgagtcaaaaggtatttgcatcaaacgagtgactatcactggggtgacgaacgccgaacccctccactacaagcgcgaccatcacggtaagcccatactggacaacaacggcaaccgaacgccagccgacttcgtgtccaccgggaacaaccaccacgccgccatataccgcgacgcagccggaaatctacaagacaacgtcgtttccttctacgaggccgtcgcccgagtcaaccaagggctcccgataatagacaaatcgctcaacaaagaacttgggtggcaattcctgttctccttaaagcaaaatgaatgcttcgttttcccaaacgaaggatttgaccccctcgaaatcgacctctacaacccagccaacaacaagctgatcgcagcgaacctcttccgggtccaaaactttagccggctgcaatacggcaacaacatcatccgcgactacaactttcggcacatctacgagacctctgtagaaaaccgcaaggagcttaaagacatcgcttacaagcaagtcaaatccctacccatctttgagaaaatcattaaagtccgaataaaccacataggacaaatcgtaaaaactggggaatactga

SEQ ID NO: 6785 - RNA, 4224 nt, synthetic construct
  misc_feature 1..4224: note = Cas9 variant
  source 1..4224: mol_type = other RNA
atgatccgtaatatcctaggcctcgacttaggcgtctccagtattggctgggcatacgtccaagaagacagcaaaaattccgagaacaaccggatcataaaactgggcgtaagggtcaaccccctcacggtcgacgaacagctaaacttcgaaaagggaaagccgatcactaccaacgcaggccgcacactcgccagatcggcaagacgcaacctccagcggtttaaactccgcagaagcaacttaatggacgtgctcaagaaaaacaacatcctaaaggagacagacctccttgcggaggtaggcaagaatagcacatttcagacacaagaactaagagctaaatccgcgaaagaaaagatcgaactatccgagttcgcacgcgtgttgttactgatcaacaagaaaaggggatacaaatcgtccagaaaagccaaaaacgacgaagacggacaaatagtcgacggtatggcagtcgccaaaaagctgttcgaggaaaacctaactcccggagagtacagctaccaactcctacaacagggcaagaaacagctccccgacttctaccggtcagacctgcaggcggagttcgacaaaatctgggacttccagaaacaattcaatcccgaaatatttacaaacgaactgtacgaaaaactccaaggaaagaaccggaacgctacttggaaggaactcgagttcccgttttcactcgtcggaataaagcaaacgggcacgatgcaggaaaagaaagtcgaaaaatacttttggcgaagtgaagccgtcaagaaacaactagactttgaaagcctcgcagtagtcttccaggagatcaactccaacctaaacaacagttccggttacctgggcgcaatctccgaccgctccaaagaactatacttctacaaccagaccgtcggcgagtacctgttccaacaactaaagacaaatccacacaccaaactcaaaaaccaagtgttttaccgtcaagactacttggacgagttcgaaaagatctgggaaacacagtccaagtaccacaaggaactaaccaaagaacttaaagaagaaatccgcgacatcacgatattttaccaaagaaagctaaagtcacagaaaggcctaattagcatatgtgagttcgaaaaccgcgagatcgaaatcacagaaaacggtaaaaccaagaagaaaactgtcggtctaaaagtggccccgaaatcaagccccctattccaagagttcaaaatttggcaggtactgaacaacctgcaattccagaacatagagacaaaagaagtgttccctatcgacctcgacttcaaacagtcgattttcgacgaggtaaacatcaaggggaaactgagcgcaaaagacgtgctcgacttagttggatactccggtaaagagtggaaaacaaacttcaaagaaatagaagggaactacacaaacgagaacctatacacagctttcctaaaaataatagctagcaaagagatagagttccccaaggagttcaaaatcaccatcgacgacgaaataaaagtctccaaaataaacgcctccgccgaaatcatcaaactattcgtccgcgagaagttcagcgaattgggaatcgacacttccatcctcgacttcaacccggaactagaggggtcggactttgagaaacaagcaagctatcaactatggcacctcctctacagctacgaaggggacgactcatcatcaggcaacgagaagttgtacgaacttctagaaaacaaatttggcttcaagaaggaaaactcgaaaatcttggccgagatcggattctcgcaagactacggctcactctccagcaaggcaatgagaaaaatctacccctacataaaagagcacaaatactcagtggcctgctcgtacgcgggctacaaccacagcaagaactcactcaccaaagagcagctcgaaaacagaatccttaaagaacgactcgacatcctcccaaagaacagcctccgcaatcccgtagtcgagaaaatcctcaaccaaatgatcaatctagtcaactgtttgatcgacgaatacagtgaaaaagacaaagacggacagatagtcaaatacttcaagttcgacgagatccgaattgaactagcccgggagctgaaactgaacgcagaagaacgcgcaacaatgaccagcgaaattaacaaagccacgatccagcaccagaaatacgcagaagtcctgcaacgtgagtttggcctgaaagcacccagccgcaatgacatcatccgatataaactctacctcgagctcgcaaataatggctttaaggacctatatacagacgcaaagatagagagagagaacctattcactgacaagtacgatatcgaccacatcatcccccagtcccgcttcttcgacgactctttctcgaacaaagttctcgtcccccgcaatgccaacctcaagaagggcaacttcacagcgttcgactacctagaaatcgagggaaaggaaaaactggaaaaattcctaaatataataaaggatctatacgataaaggggccatcaccaaagccaaatacgaaaagttgcaaaagaaagactttgaaatcggggacggattcatcgagcgcgacctgcgcaacacccaatacatagcgaagaaatccaaagagatcctgttcggaatcaccaactcagtcgtaaccacgtccgggcgcataaccgacaaactacgagaggactggaacctgatcaacacaatgaaagagctcaacctcgaaaaataccgcaagctcggcctcacggaaacagtcattaactccaagggcgaggaaaaacaaaggatcatcgactggacgaagcgaaatgaccaccgccaccacgctatggacgcactcaccgtcgcattcacgacccacaaccatatccagtacttgaactacctgaacgcccgcaaggacgagaaacacaaagaacaccaaaacatcttcgccatagaaaacctaatcaccgagataatcgacaagaaaaatggcagcaaagaacggaggttcaaagagcccgttaaaaacctgcgggcagaagcccgcaagcacctcgacgagatcctaatttcacacaaagtgaaaaacaaagtagtcaccaaaaacattaacaagatcaagaagaagggcagcgtaatcgcaaaaacagagctaacgccacgaggtcaactccacaaagagaccatatacggaagtagcaagttcctcaaaaccaaggaagagaaaataagcggcaagttcgatgtggaaacaatccagaaagtccaaaacgaacggtataggaacgccctgctaaaacgcctacaagaatttggcggcgacagtaagaaagccttcacagggaagaacgttatctcaaagaaccccatattcctcaacaacgaaaagaccgaacaactcccggagactgtaacactagcgtggtacgaaatgggatacacgatccgaaaggccgtcaaccctgacaacttcaaggatttcaaaaacatcgagaaaaccatagataaggggatccgagacatcctgacaaagcggctgaaagagttcaacggtaactcgaaagaagccttctcagacctcgacaagaatcccatctggctaaataagtcaaagggaatctccatcaaagccgttacgatcaccggaataaacaacgcagaagccctccactacaagaaggaccatcttggcaaggacttcctggacgaaaacggaaaaaggatcgcggtagatttcgtatcaaccggcaacaaccaccacgttgcaatctacgaagacgaaaatggaaacctacaggagaaagtagtcagcttctacgaggccgttgagcgcgtcaaccaaaacctgccgataatcgataaggagtacaacagcgaaagcggctggaaattcttatttaccatgaagcaaaacgaaatgttcctatttccaagcgaagacttcaaccccaaagaaatggacctcttcgacgaaaagaacgtcaacctcatctccaaaaacctcttccgagtccaaaagttcaccatcaaagactatttcttccgccaccacctagaaacaaacgtagaggacagctccccgcttaaaggcataacctggaaacgggaaggcctaaacggaatagagaacatactgaaagttcgactcaatcacctgggtaaaatagtccagatcggggaatattga

SEQ ID NO: 6786 - RNA, 4227 nt, synthetic construct
  misc_feature 1..4227: note = Cas9 variant
  source 1..4227: mol_type = other RNA
atgaccaagaatatcctaggccttgatgtaggggtatcctcaatcggctgggccctcataaacgaagacatagaaaatcccaaaaacaacaagataatcaagctaggggtgcgcgtcaacccgctcaccgtagacgagcaaatcaacttcgaaaaaggtaaacccatcaccacgaacgccggacgcacacttgcgcgcggagcacgccgtaacctccaacgattcaaactcagacgctttcacctcatcgacatactacaaaagaacaacatcctaaaacaggccgacctcttggcggaagtcggcaagaacagcacattccaaacgcaggaaatccgagccaagtccgccaaacaaaaagtggagctctcggaactagcccgtatattcttattaatcaacaaaaagagagggtacaagagctcccgaaaggctaagaacgaagacgagggccaaatcatcgacggtatgttcatagccaaaaagctctacgatgagaaacttacacccggagaatacagttaccaactactgaaagaatctaagaaacagctgccagacttttaccgcagcgacctccaaagcgagttcgataaaatatggaattttcaaaaacaattctacccagaaaactttagcgacaacctctacaaagaactgcaagggaaaaacaaaaatgcgacctggaagaccctggagatcccattcagcctagtcggaataaagcaaacgggcacactgcaagaaaagaaactagagaaatattcatggcgcagcgacgccgtaaagaagcaactcgactacgagaaactagcggtggtgttccaagaaatcaactccaacatatacaacagcagcgggtacctaggcgccatcagcgatcggagcaaagagctctacttcaacaatcaaactgtgggagaatacctctacaaccagatcaaggagaacccgcataccaaactgaaaaaccaagtcttctacagacaagactacctcgatgagttcgagaaaatatgggaaacccaaagtaaataccacaccaccctgacgaaggaactgaaggaagaaatacgcgacatcataattttctaccaacgtaaactaaagagccagaaaggattaatatctatctgcgagttcgaaaaccgcgaaattgaaataaaggaaaacggtaagatcaagaaaaagacagtgggccttaaggtcgcgcctaagtcaagcccattattccaggagttcaaaatatggcaaatactgaacaacctccagttccagaacatcgaaagcaaagagatcttcccaatcgacctcgacttcaaagaatccatattcaacgaggtgaatataaaaggacgcatcagcgctaaagcagtcctcgacctactcggctacagcggcaaagaatggaacccgaactttaaggacatcgaaggcaacaacaccaacgagaatctatacaacgcttacttaaagatcatagcggacgaagagttcgaactccccaaggagttcaagttgaacggcgacgacgacctatacgtaagcaaaatagcgtgctcagcatccaaaataaaagacttcgtcaaggaaaagttctcagaaattggcatcaatacaagtatcctggacttcaacccagaactcgaaggtaaagacttcgaaaaacaagcatcctaccaattctggcacttgctctactcctacgagggcgacgactcccaatcggggaacgagaagctctacgagctgcttgagaaaaagttcggatttaagaaggagcacagcaaaatcctaagcaacattggattccccctagactacgggaacttatcaactaaggcgatgagaaagatcattccgcacctcaaggccggactcagcttcgcgaagaaaagcaaagaggacaacattctctcagccacagcgatggcgggctacaaccacagtaacagctacaccaaagaagacctagcaaagcgagtactgaaagagaaactggaagtctttcccaaaaactcgctacggaacccagtggtcgagaaaatcctcaaccagatgatcaatctagtgaacgaggcagtcgaagaatacggcacgatagacgaggtccggatagaactcgccagggaactaaagaaaaacgcagaggaacgggccaacatgacgagcgagatcggaaaagccacgctgctccaccagaagtatgcagagatattgaagaaagagttcgacatccctgtcccaagcaggaacgacatcattcgctacaaactctacctagaactagcgaacaacggatacaaagacctctacaccgacgtccagatcaagcgcgaggaacttttcaccaacaagtacgacatcgaccacatcatcccgcagtccagattctttgacgacagtttctcaaacaaggtcttagtcccaaggggcgcgaacctcaagaaggccaaccaaacggcgttcgactacctcgaaaacgaagacaagcagaaactcgaaaagttcctaaacataatcaaaaacctttacgacaagggcgagataacgaaagccaaatacgagaagctacagaagaagggctccgacatcggcgagggcttcatagaacgcgacctacgtgacacccaatacatagcaaagaaagcgaaagaaattctcttcgggatcacacacagcgtgatcagcacctcggggaaaataactgataaacttcgcgaagattggaacttggtaaatacaatgaaagaactcaacctggacaaatacaagaaactaggcctcaccgaaacactactgaactccaaaggcgaagagaaagagagaataatcgactggtcaaagcggaacgaccacagacaccacgcgatggacgctctcacagtggcctttacaacgcataaccacatccaatacctgaactacctgaacgcacgtaaggacgaggaccacaaacagcacaaggtgatctccaacattgaaaacctcatcaccaaggtcttcgaaaagaaaaacggcgcgaaacagcgcaggttcatcgaaccgatcaacaacttcagggtagacgcaaagaaacacctcgacgagatactaatctcacacaaagcgaaaaacaaagtcgtcacgaaaaacataaacaaaataaagaagaaaggcagcgtcgtggccaaaaccgagcttactccccgcggccagctccataaagaaaccatctacggaagttcaaaatttctcaaaactaaagacgagaaaatcagcggcaaattcgacttggaaacaataaacaaggtgcagaacgagaagtacaagaatgccctcctgcaaagactcagagagttcggagaagactccaaaaaggcattcacaggcaaaaacgtcatctccaagaaccccatatacttagacgaggagaaaacccttcaaatacccgaaagcgtcacactggcctggtacgaaatgatatacacaatacgaaaaccagtaaatcccgacaacttcaaagattacaaaaacattgacaaggtgaccgacgagaagatacgagcggtactcaccgacagactaagaaaattcaacgggaacagcaaggaagcgttctctgacctggagaagaacccaatctggctaaacaaaagtaagggtatcgccataaagaccgttacaatcactggcatgtctaatgtagaggcactacactacaagaaagaccacctcgggaaagaaatcttagacaagaaaggagaccgaatgccagtagactttgtcagtacagggaacaaccaccacgcagcaatttacgaggatgcaaaaggaaacctccaagagcgggtcgtcagtttctacgaagccgtggaacgagtgaaccaggggctgagcgtcgtcaacaaagactacaatgccggcctgggctggaaattcctattcaccatgaaacaaaacgagatgtttctgttccccagcgaagacttcaatcccaaagaaatagacctctacgacgaaaagaacctgaagctaatcgcaaagaatctattccgtgtacaaaaattcggggagctgtccaaatcaggcttctggttcagacaccacctagaaacatctgtcgacgtgaagaaagaactccgtaactactcctacctagacttctacagcaaagacttcatgaaaaccatcgtgaaagtccgcctcaaccacttaggcaagatagtacaggtcggggaatactga

SEQ ID NO: 6787 - RNA, 4230 nt, synthetic construct
  misc_feature 1..4230: note = Cas9 variant
  source 1..4230: mol_type = other RNA
atgtctatcatcaacttccaacgaagagggctcatggagacccaagccagcaaccaattaataagctcccacttaaaagggtacccgataaaagactacttcgtcggcctggacataggcacatctagtgtcgggtgggcagttacaaacaaggcttacgaactactcaaattccgaagccataagatgtggggatcacgactcttcgacgaaggcgagtcagccgtagcacgccggggattccgaagcatgcggcggcgcttagaacgccgcaaactaaggctgaaactgctcgaagaattattcgcggacgcaatggctcaagtagacccaaccttcttcatgagactccgcgaatcaaagtaccactacgaggacaagaccaccggccatagcagcaaacacatcctattcatagataagaactacacggaccaggactactacaaagcctaccccacaatctaccatctgcgggcggaactcatgaaggacggcaccgacgacatcaggaaactcttcctcgccgtgcaccacatacttaaataccgaggaaacttcctctacgaaggggcaacatttgacagcaacgcgtcaacactcgacgacgttatcaagcaagcactcgaaaacatcacattcaactgcttcgactgcaacagcgcgatcagctcgattggacaaatactcatggaagccgggaagaccaagagcgacaaagctaaagccatcgaacatctggtagatacatatatcgcaaccgacaccgtggacaccagcagcaaaacacaaaaagaccaagtaaaggaagacaaaaagcggctcaaggctttcgcaaacctggttcttggcctaaacgcctcattgatcgacctatttggatcggtagaagaactagaggaagatctcaaaaagctgcaaatcaccggcgacacctacgatgacaagagggacgaactcgcaaaggcctggtcagacgagatctacatcatagacgactgcaaaagcgtatacgacgccatcatcctcctgagcataaaggagcctggactcaccatcagtgaatccaaggtaaaagcattcaacaaacacaaggacgacctagcgatactcaaatcactactaaagtcagaccgttcgatatataacaccatgttcaaagtcgacgaaaaagggctccacaattatgtccactacatcaaacagggtagaacagaagaaacttcgtgcaaccgagaagatttctacaaatatacaaagaaagttgtcgagggcctacctgactcaaaagacaaagagtacatcctatccgaaatcgagctccagacgctcctccccctccagcgcatcaaagacaacggcgttatcccctaccaactgcacctggaggaactaaaagtaatcctggcgaaatgcggtccgaaattccccttccttaacgaagttgccgacggcttctcagtcgctgagaaactaatcaagatgctagagttcaggataccatattacgtcggccccctaaacacacaccacaacgtagataatggcgggttcgcttgggcagtcaggaaggccagcggccgcgtcaccccctggaactttgacgacaaaatcgatcgagaaaagagcgcagcggccttcatcaaaaacttaaccaataaatgtacctatctcctgggagaagacgtgttacccaagtcgagccttctctacagcgagttcatgctcctgaacgaacttaacaacgtgcgcatagacggaaagcccctcgaaaaggctgtcaaagagcacctaatcgaagcagtcttcaaacaggaccataagaaaatgacgaaaaatcggatagaacaattcttaaaagacaacaactacatccccgaaaaacataaaccagaaattacaggactcgacggcgagatcaaaaacgacctcgcttcctaccgggacatggtgcgaatattgggaaacaacttcgacctatcaatggccgaagagatcattactgacataacgatatttggagaaagcaagaaaatgctacgcgaaaccctacgaaacaaattcagcagcaggctcgacgacgaggctatcaaaaagctcagcaagctgagataccgcgattggggacggctgtcccgaaaacttctcaacgtcatagaaggatgcgacaaagctggtgacggtacccccgaaaccatcatcatcctcatgaggaacttctcgtacaaccttatggaacttttaggagacaaattctcattcatggaaagaatccaggagatcaacgcaaaattgatcgaaggccaaatcgtaaacccacatgatataatagacgacctagcattaagcccagccgtcaagagggcagtatggcaagccctccgtattgtagacgaaatagtccacatcaagaaaacccttccggcccgaatcttcgtcgaagtgacacgatccaacaaagcagagaaaaagaagaaagacagccgacaaaaacgcctttccgacttgtacgccgccatcaagaaagatgatgccctactgagcggcctcacgaacgaagagttcggagggcttaaatcaggactcgctaaatacgacgacgcagcactccgctctaagaaactctacctatactacacccagatgggtaggtgcgcttacaccggcgaggtgatagatctctcccagctcaacaccgacaactacgacatcgaccacatctacccccgttcgctgactaaagacgacagcttcgacaacctagtgctatgcaaacgcacagctaacgctcaaaaatcagatacttacccgattagcaaagagattcagaaagcccaaaaggctttctggatattcctgaaacagcagggactcatttcagaacgaaaatacgaacgcctcacacgcatcactcccctcaccgcggacgaccttagcggcttcatagcccggcagctagtagaaacaaaccaatcagtcaaagcagccaccacccttctacgccgcctgtaccccggagtcgacgtagtcttcgtcaaggccgagaacgtaaccgatttccggcacgacaatgacttcatcaaagtaaggtccctcaaccaccatcatcacgcaaaagacgcatacctcaacatagtcgtagggaacgtctaccacgaacgcttcaccagaaacttccgcgctttcttcaagaaaaacggcgccaaccgaacctacaacctcgccaaaatgttcaactatgacgtcaactgcacaaacgcaaaagacggcaaagcctgggacgtaaaaacatccatggacaccgtcaagaaaatgatggcatcgaacgacgtgcgcgttacgaaacgtctgctagagcaatccggagccctggcagacgcaacggtatataaagccgcggttgcagaaaaagcaaaagacggcgcctacattggaatgaaaacaaaaagcagtgtattcgcagacgtatctaaatacgggggtatgacgaaaatcaaaaacgcatactccatcatagtacagtacgcagggaagaaaggagaggtcgtaaaagaaatagtgccgctaccaatatacctaacaaaccgcaacaccaccgaccaggacctaattgactacgtcgcttcaataatcccacaggccaaagacataagcatcatctacaggaaactatgcatcaaccaactcgtgaaagtcaacggcttctactactacctagggggaaaaaccaattccaaattctgtatagacaacgcaatacaagtaatagtctccaacgagtggatcccctacctcaaggtgctcgaaaaattcaacaacatgcgcaaagacaacaaagacttaaaagctaacgtcatttcaaccagagcactggacaacaagcatactatcgaagtacgcattgtggaggagaaaaacatagagttctttgattacctcgtctccaaactaaaaatgcccatataccagaaaatgaaaggcaacaaagccgccgaactttcagaaaagggctacggactattcaagaagatgtccttggaagaacaaagcatacacctcatcgagctactaaacctgctaacaaatcagaaaacaaccttcgaggtaaagccgttaggaataaccgcctcgagatcaacagtgggctccaagatcagcaaccaagacgagttcaaagtcattaacgaatcgatcactggcctctattcgaacgaagtcacaatcgtctga

SEQ ID NO: 6788 - RNA, 4233 nt, synthetic construct
  misc_feature 1..4233: note = Cas9 variant
  source 1..4233: mol_type = other RNA
atgaccaaaaacatactaggcctggacctcggggtatcatcaatcggctgggcactcgtccaagaaaacagcaaaaacccggaaaacaacaaaatcgtaaaacttggcgtccgtgtaaaccctctcacggtcgacgaacaaattaacttcgaaaaaggcaaacccataaccaccaatgcatcccggaccctagcccgctccgcccgaaggaacctccaacgttttaaacttagacgagcaaacctcatcgatgtcctaaagaaaggcaacatactgaaacaaggagacctactgaccgaaatcggcaaaaatagcacattccaaacgcaagaattgcgagcaaaaagcgcaaaagaaaaagtcgaactctcagacttcgtgcgcatcctcttactcatcaacaagaaacgaggctataaatcgtcgcggaaggccaaaaacgaagacgaagggcaaatcatagacgggatggccgtcgccaagaaactgtatgaagaaaatatcaccccaggggaatactcctacaagctgctccaagaagggagaaaacagctccccgacttttaccggagcgacctacaagcggagttcgacaagatctggaatttccagaaacagttcaatccagaaatattcaccaatgaactatacaaacgcctacaagggaaaaaccgcaacgccacctggaaagaactcgaaatccccttctacttggtcggaattaaacagatcggcacaatgcaagagaagaaaatagaacggtacttctggagatccgaagccgtcaagaagcaactcgacttcgaatcactagcagttgtatttcaagaaatcaactcaaacctaaacaacagcagtggctacctcggcgccatcagcgaccgctcaaaagagctttacttcaacaaccaaaccgttggcgagtacctgtacaaccaactcaaaatcaatccccacaccaagctcaaaaaccaggtattctacagacaagactacctagacgagttcgaaaagatctgggaaacccaagcgaagtatcacaaaaagctaacgaaggagctaaaagaagaaatccgcgacatagttatattctaccaacgcaaactaaaaagtcagaaaggcctcatcagcttctgcgagttcgaaaacagggaaatagaaatcaccgtcaatggcaaaacgaaaaagaaaactgtcgggttaaaagtagtacccagatcatcaccactcttccaagaatttaaaatttggcagagactaaacgacctcgagttcaaaaacgtagaaaccaaagaaatattcccgctagagctagagcacaaggaaatactcttcggaaacctaaatatcaaaggaaacctgtccagcaaagagttgattgagcagctcggctacccaagcaaagagtggaaatgcaactttaaggagattgacggcaacaaaacgcacgagaatctctataccgcattcctcaaaatcatcgccaacgaggggatcgaatttcccaaggagttcaaactatcgatcgatgacgacataaaggtgagcaaaatcgacgtatcgagcgaaaagatcaaagagttcataaaagaaaacttcttgaagctaggcattaacacctccatactggacttcaaccccgaactagacggcaaagacttcgagaagcaagaaagctaccagctgtggcatctgctatactcctacgagggcgacgacagcgcgtccgggaacgaaaaactatacgaactcctcgaaaagaaattcggtttcaaacgcgagtactcgaaaatactcgcagacgtcggattctcgcaggactatggttcactctcgtcaaaagctatgcggaaaatcttcacatacatcaaagagaacaaatacagcgaggcttgccacctcgccggatacaaccacagcaaaaactcgttgacaaaagagcagctggcaaaccgcatcctcaaagagcagctcgaaattttgccgaaaaatgcgctgcgaaacccagtcgtagagaaaattctcaaccagatgatcaacctcgtgaatgaagtcatcaaagagtacggcaagccagacgagatacgaatcgaactcgcccgggagcttaagaaaaacgccgaagaacgtgccaacatgaccagcgacatctccaaagcgacgctcctacaccaaaaatatgcagaggtcctccaaaaagagttcggcatcaaggcaccaagccggaacgacatcatccggtacaaactatacctcgagcttgcaaacaacgggtacaaggacctgtacacgaaccagaaaatcgaaaaggaaaatatatttaccgataagtatgacatagaccacatcatcccacagagtcgcttcttcgatgacagcttcagtaacaaagtactggtgccacgctgcgcgaaccaagacaaggacaactacacagccgtcgactacatcgagaagaaatacggagaaagaggcaaagaagacttcctaaaccgaatacacctcgtattcaaatcaaaagaggctattgcgggaaagagcgagtcccagatctcgtccatgaacaccaaattcctaaaactgcagaagaaagggtcggagatcggtgaaggatttatcgaaagagatctaagagatacacaatacatcgcgaagaaagccaaagaaatcctctttggaataaccaactccgtcatttccactagcggaagaataacagataaactcagagaagactggaatctggtcaacacaatgaaggagctaaacctagagaaatacaggaaactgggcctcacggaactaatcgctaattcaaaaggcgaagagaaagagcgaataatagactggacgaaaagaaacgaccaccgccaccacgcgatggacgccctgaccgtggccttcaccactcataaccacatccaatacctcaactacctcaacgcccgtaaagacgaaaaacacaaggagcaccacaacattttcgccatagagaatataataacagaaattgtcgagaagaaaaacggctcgaaagaaaggcgcttcaaactcccaatcaaaaacttcagaacggaagcgaagaaacaactcgaggaggttttaatcagccacaaagccaaaaacaaagtagtgaccaagaacataaacaaaaccaaaaagaagggcggggtcgtgagcaagatcgttctcacaccccgggggcaactgcacaaagaaacgatctacggctcggcgaaatttctcaaaacgaaagaagagaaaatcagtggaaaattcgacttggaaaccatcaacaaagtccagaacgagaagttcaagaatgccctcctcgaccgactaaaagaatttaacggcgattcaaagaaagccttcacagggaaaaacgtgccggccaagaacccgatctaccttaacgagcagaaaaccgaacaagtaccagaaagcgtagtacttgcgtggtacgaaactggatacaccatccggaaagccgtcaacgccgacaatttcaaggattacaagaacctcgaaaagatcatagacaagggcgtcaaagaaatactgaaaaaccggctcaacgccttcaatggcaacgccaaggaggctttcagcgacctcgagaagaaacctatatggctgaaccaatccaagggaatcgcagtcaaaacagtcacaatcaccggcatcaacaacgctgaaacgctccactataaaaaggatcacttcggaaacgagttactcgacgaaaacggtaagaagatcccagtggacttcgtgagcaccggaaacaaccaccacgtagccatctacgaggatgccgatggcaacctccaagagcgcgtagtgagcttttatgaggcagtagaacgagtcaaccagggactcagtatcatagacaaagaatacaaccaggacctcggatggaaattccttttcacaatgaaacagaacgaaatgttcctgttcccctccgaagacttcaaccccaaagagaccgacctgttcgatgagaaaaacctaaaccttatcagcaaaaacatgttccgggtccagaaattcggaagcctcctgagcgggttctggttccgtcaccacctcgagacaactgtagacctgaactcctcactaaaagacacgagctataaagtcatacaatcatgcaacaacctcaaactaatcgtaaaagtccgacttaatcaccttggcaaaatcgtgcagattggagaatattga

SEQ ID NO: 6789 - RNA, 4236 nt, synthetic construct
  misc_feature 1..4236: note = Cas9 variant
  source 1..4236: mol_type = other RNA
atggtcaagaaagagtacttcatcgggttagacatgggaacctcctcagtcggatgggctgtagcggacacgaattacaacttactccgagccaaaggcaaagacatgtggggcgtgagactcttccccgaagccagcactgcagccgatagacgctcgcaccgtaccgccagaaggaacaacaaacgtaaggcggcaagagagggcttcctccgtgaaatcttcgaagatgaaataaataagatcgaccccggcttcttcgaaagactgaaggaaagtaaatactacctagaagacaaactcacagacacgccattcgtactcttcgcggacaagggatacaccgataaagaatactacgacgaatacccgaccgtctttcatttaatcaaagaactcatatccgagaaaggtctcgagccacacgacatccgactggtgtacctcgcctgcttgaacatctacaagcaccgtgggcacttcctcaacgacacgctgagcggagatggcatagacaacatcaactcgctctgcaacgacttcacaagctacctcgccgactacaaccaaaattcggaagacgacggaaccgagaaaatggacctcgacagcacggttctggcgggagttttcgaagagacactctgtaacaagcacctctccaacagcgcaaagaaacgagacctaatagacaaactcggaatcacgaacaagacgaaatacctcacagaaatgatggcgctcattagcgggctcgcctcctcagtcagcaacatgttcgccaaggacacctacgacgaagaacagaagaaatttaaactgagcttccgaagctcaaacctcgacgaagacatggtcaaagttcaagcgatgctcaccccggaagaatacgagatgatttgtataatgaagaaaatacacgattggagcgtcgtatccgtcataatgggaagccacaaatacataagcgacgcgcgggtagagctctatgaaaaacataaacaggatctcgccaaactcaaagccatatataaagaatacctaccagacaagtacgacgcaatgttccgcgagatgacggacaactcctactcggcctatgtgggcaaagtatcgtccaacaagaaaagccaaacaggaaaccacaaagtccgcatgcaacggcgcggtgcaaaatgcaagcaggaagacttctacgaccgcataaagaaagaaatcaactcggtaccccaagaggagaaaatcgatatactacaagacatggaaaccaacagcttcctccctaaacaattaaccaacgaaaacggggtgataccgtaccagctccacctagccgaactcaagaaaatactggacaacgcctccacctacctacccttcctaaactccgcggacgaaactggcatctccaacaaagacaaaatcatccaattgttcgagttccgcatcccttactatgtgggacccctattcaaaagtgaaaagaacaaaacaaacgcttgggtggtgaggaaagaatcaggcaaagtctacccgtggaacttcaacgaaaagatagatgaaaaacaaagcgcagaaatcttcatagaacggatggtacgccactgcacatatctcaataacgagagcgccctccccaaaaattccctaaaatacgagcgttttcgcgtgctgaacgaactgaacaatttacgaataaacggtgagcggatcagcccagaactaaagcaaaggatatacaacgaactattcaaagtgaaaaagaagcgcatcacaaaatcaatgctatgcgagtatctgtacaagaacggcatagcggacaaagactcggagctctctggcttcgacggcacattcgccaacgctttactaagctacggcaaattccgggaactcttcaacgtcgacaccctcacggataagcaagaggcagcagcagaagacatcatcaaatggagcacagtatacggagacagcaagaaattcctccaggagaagatcgaagagaattacggcccagagtcggaaaacccactactcgacaacaaacaaataaagcgcgtgatgggctacaagttcactgactgggggaacctaagccgggagttcctgaacctggagggagcagacaaggataacgacacaaccacgggagaagttatgccactaataacccgaatgtgggaggagaactacaacctaatggagctcatgagcaacaaattctcataccgagacgcactggccgaaaagacggaggaaatagaaaagaccctgacagacattgaatacgaagacctggaggatttgtacatcagtgccccagtcaaaagaatgacctggcagacattgctaatcctcaaagagatctaccagatcatgggctacgcaccgaagaaaatatttgtggaaatggctagagaggaggaagaaaaagtgaacggcaaaggcgcgagaaagtcctcccgtaagaaaaggctggaggacctgtaccgcaattgtaaagacgcaagcaaggagctctccaccggcatcaaaaacgcggacgaagccatcctccggaggaagaaactttacctctactacctacaaaaaggcaaatgtatgtacagcggaaaaactatcgacttcaaaagcctcttcacaaacaactacgacatcgatcacatatacccacaaagcgtcgtgaaagacgactccctggaaaacaacatggtgctagtagaacgcaactacaacaataagaaatcggacacattccccatatttagcgactggcaaaataaaatgaagcccttctggaccatgctaaaggaacaaggatttataaatgaggaaaagtataaacgcctaacccgcacggacgaactcacagacgacgaactggcaaacttcgtgaacaggcagctagtggagacccgacaagcaaccaaagtaatcgccgaactactgaaaaattcattcgacgatatcgactcgaagatagtctacgccaaagcaggcaatgtgtcagagttccggcacaagtttagcatgaagtacgacaaggaaaccgaaaagagcagcgtcatccaccccgaattagtaaaatgccgcataataaatgacttccaccacgcaaacgactcatacctaaacatcgtagttggcaacatctatgacgtcaagttcacccaaaacccatacaattacatcaaagagtacaagaagcagaaaaacaattccgcactctcagaacaagaaaaagagaaataccacatggataagatcttcaacttcgacgtaaagagaaacggcgaagtggcctggatttccagaggagacaataagacccttgaaacggtactcaaagtcatgcggaaaaacacccccatcgtcaccagaatgaacttcgaggagcacggccaattagcggacctcactatctactccgcatcagacgcactgtccaaaaagggcgtaggttacataaaagtcaaagcctcggacgcgcgcctcgatgtcctcaaatacggcgggtacaaaaagtataaaggagcctacttcttcctggtcgagcacaccgagaaaaacaagcgagtgcgcacgatcgaaaatatgcctctctacctcaaaaacgaactaaacaccaaagagaaaatcgaactctggtgtgccgacaaagaaaatgggctaggcctcgtggatccggatgtccgcttagggaaaatcaaactctacagtaagattcggatagacggattcgacctgtacctcacaggacggacaggaaacaatctgctcaccagtaacgcggtccagctaaagatcggaagcaacaaaccgagcgacaacgataagctgttctggagatactatataaacaaactcagcaaatacacggaaaacagcgaatttgtcagcatacaaaataacatcaaattgtacgatctgttcgtcgagatcaataacgccggggtctacagcaagcggcaaaatcccatcggtgacaagctacttgagggcaggtccaagttcatcaacctcacactaagcaaacaggtcgaaacactacttggaataatccggatctactcactggagaaccagggagcagacctctcaaacatcggaggccaagagaaaaacggaaccatgaagccccacaaacgcataagcgacaagaaagaagtcctcctaatcaaccagagcgttacgggactatacgagtcaaaaatcgacctcctcaagatctga

SEQ ID NO: 6790 - RNA, 4236 nt, synthetic construct
  misc_feature 1..4236: note = Cas9 variant
  source 1..4236: mol_type = other RNA
atgaaaaacatcctcgggctcgacctcggcaccaacagcatcggctgggcgctaatcaagcagaacgctgaggagcgccaaggctcaatactcggaatgggcactcgcgtcctccccatgagccaagacgtccttggagacttcgggaagggcaacagcgtatcccaaacagcggcacgcacaggataccgagggatacgacggttaagggagcgcttcctcctccgtcgagaacgcctacacagggtcctgaatatcttaggcttcctgccatactactacgcagcccaaatcgacttcgacaaaagattcggcaaattcaaagctgaaactgaacccaagctcccatataacaacgagggatttatcttcaaaaacagcttcgaggaaatgctgtctgacttcaagatctcgcaaccggaactcctaagcggcaacaagaaggtcccatatgattggacaatctactacctacggaaaaaggctgtttcccaaaagatagaaaaggaggaactagcatggatcctactcaattttaaccagaaacgcggctactatcagcttcgtggagaggacttcgacgaggaaaaggacaaaactttcgtcaccctaaacgtagacaaggtaatcgactccggtgaaaaagtcaagggaaatatactgttcgacatctacttcacgaacggatggaaatacgaaaaacaaaccacgaaaccagaagactggttaggacgctcgaaagagttcattataacggaatcgcttctcaaaaatggggaggtgcggcgcaccttcaaagctgtcgattccgaaaaagactggatcgcgattaaggccaagacagaacaagagatcgagaccgcccataaaacggtaggaagctacatttacgacgccatcctccaaaatcccaaacagaaaatcaaaggaaaactcgtacgtaccattgaaagaaaattttacaaggaagaattacgcaagatcctagaaaagcagaaagacttccaccttgaattacaaaacgaagatttatactcggactgcgtccgcgagctctaccgaaacaacgacacacaccagctcagcctcgccaagaaatcattcatacacctattcctcgaggacatcatattctaccagcgacctctaaaatcacagaaaagctctgtatccaactgcaccctggagtgtcggaaataccgggataaaaacggcgcagaaggtatccaattcctcaaggtcatcccgaaatcaaacccatactaccaagagttccgaatttggcaatggatgtcgaacctcaagatataccggcgtgatgacgacgtaaacatcacgagcgaatgcctcaaaacggcggaagattacgaagacctgttcgtgttcttgaatatcagaaaggaagtcgatcaaaaagcctgcctgcgccacttcaaactcagcgagaaaacccaccgctggaactacgtagaagacaagaaatatccgtgcaacgaaacgggcaccatgatatcagaacgcctcaagaaggtcggggactcccctgacaacatcttcacccgggaaatggaacaacaaatctggcacataatatactccgtcaacgacaaaaccgagtacgaaaaagccctcaaatccttcgccaagaaaaacgagctcgacaacgactccttcttcgaggctttccggaaatttcctcccttcgactcagaatacggctccttcagcgaaaaagccataaagaaactcctcccattgatgagaatcggaaaacactggaactgggaagcggtcgacgagaaaatcaaaaatcgaatccaaaagataatcatcggcgaatacgacgaaaacatcaaagacaacataagagaaaagaccctcagcctacaaaaagaatccgacttccaagggctaccgctgtggctggcacaatacgtggtctacgggcggcacagcgaggcttcggtagccggaaaatggaacagcgtagacgacatcgaagagtacctgaaagagttcaaacaacactcactgcgtaacccaatcgtcgaacaagtcatcatggaaaccgtgcgcgttgtcaaagatatctggataaagtacgggaacggagccgcggacttcttcgacgagatacacatcgagctcggccgcgagatgaagctcccagccaaggagcgaaacaagatgacccagaaaatttccgaaaacgaaaacactaacctgagaatcaaagcacttctggccgaaatgatgaacgactcggaggtccaaaacgtacgtccctactcacccatgcaacaggaaatactgaaaatctacgaggacggcgcgctcaactcggagatatcggtggacgacgacatactaaaaatctcaaaaaccgcacagccaagcccgtccgacctcaagaagtacaaactttggctggagcaaaaataccgctcaccgtatacaggcgacatcatacccctcaataaactgttcaccaccgaatatgaaatagagcacataatcccacaatcacgatatttcgatgactccttttccaacaaagtcatctgcgagtcccttgtcaaccggctcaaagacaattacataggcctaggcttcatcaaacaatttcacggctacaagatctcagacaaaacaaaagtattcgaagtcgaggaatacgaagatttcgtcaagaaaaactatgccaacaaccggtcgaaacggtcaaagctactcctagaagaaattcccgaagagatgatcgaaagacaactaaacgacacaagatacatatccaaatacatcagtgggatactatccaacattgtgagaaagaaggaaaacgacgagggcgtaaactcaaaggacatcataccaggcaacggcaagataacgagccaactaaagcaagattggggactgaacgacgtgtggaacgacctgatcctcccacggttcgaaagaatgaacgagctcaccaaaagcagttacttcaccgtctggaacgagaaataccagaagttcctcccaaccgtaccggtagaatttagtaaggggttcagcaagaaacgcatcgaccaccgacaccacgcactagatgcactcgtgatcgcctgcgcgacgaaagaccacgtcaacctcctgaacaacaaaagtgcaaagtccgaaatgaaaagatacgacctcaaacggaagctgatgaagttcgagaaaaagacgtaccagcacagccaaacgggcgaaagaatagtaaaggacgtccccgtagagttcctgaaaccatggaacgacttcacggtggaagcgaaagaaaacctagaaaagatcatagtctcctttaaacaaaacctacgcgtaatcaacaaagcgaccaaccattatgaaaagtggatcgaaaaagacaatgtcaaagtcaaaggcctcgtagagcaacaagggctaaactgggcaatccgcaaacccctccacaaggatacagtcagcggaaaagtagacctcccgggtatcaaagtgcccaagggaaaaatcctcaccgcaacacgaaagagcatagacacatcattcgacctcaaaaccatcaactccataacggacacgggtgtacagaaaatcctcaaaaattaccttgaatacaagggcaactcgagcgaggaagccttctccagcgagggaatagaggacatgaataataacatagaaaaattcaacgagggaaagctccatcaacccataacgaaagtacgcatattcgaactcggctcaaaattcccactaggccaaatagggaataaaaagcacaaatacgtggagaccgcgaaaggaacaaacctcttcttcgccatctacgaggacgacaagggtaagagaacgtatgaaaccatcccactcaacgaagtcatcgaacgtcagaaacagggccttgccccagtgacactaaagtcgaaaaacgacttctatctctgcccaaatgacctagtgtacgtagcggctgagggcgagagtgtaaataaaatagatttcaagtacgccagtcaagaatttatacacaatatctacaaagtcgtctcgttctccggaagccagatattcttcgtcaaacaaaatattgcagtatctatcgtcaacaaggccgagttctctacgctcaacaaaatggaacgagcggtcgatggaaagatgatcaaagactgttgcataaagctcaaaatcgaccggatcggaaacatcaccaagagctga

SEQ ID NO: 6791 - RNA, 4239 nt, synthetic construct
  misc_feature 1..4239: note = Cas9 variant
  source 1..4239: mol_type = other RNA
atgatgacgaagaacatactcggcctcgacctcggaaccaactcgattggctgggccctaataaaacagaacgcggaggaacgaaagggatcgatactcggcatgggcacccgggtattaccaatgagccaagacgcgctcggggactttggaaaaggtaactcagtgagccagaccgcagccaggacgggctaccgtggggtgcgacgcctgcgcgaacggttcctcctcaggcgcgaacgcctacacagagtgctcaacatactgggcttcctgcccgactactacgccgcccaaattgacttcgacaagcgcttcggcaaattcaaagccgagaccgaaccaaagctaccatacaacaacgaaggattcatcttcaaaaatagcttcgaggaaatgctctcggacttcaaaatctcgcaaccagaactgctgagtgagaacaagaaaatcccatacgactggacgatctactacctccgcaagaaagccgtatcacaacgaatagagaaagaggaattagtgtggatactccttaactttaaccagaaacgtggctattaccaattacggggcgaagacttcgatgaagagaaagacaaaaccttcgtaaccctgaacgtcgacaaagtaatagacagtggcgaaaaagtcaaagggatcgtcctgttcgacgtctacttcactaacgggtggaaatacgaaaaacaaataaccaaaccagaagactggcttgggcgatccaaagagttcatcatcacagagtccctcctcaagaacggggaagtaaagcggacattcaaagccgtagacagcgagaaagactggatcgctataaaagccaagacagaacaagaaatagaaatcgctcacaaaaccgttggctcgtacatctatgacgccatactacaaaacccgaagcaaaagataaaaggcaaattgatccgcacgatagagcgaaaattctacaaagaagagttacgcaagatactcgaaaaacaaaaagagttccacccagaacttcaaaatgaagatctctacagtgactgcgttcgggaactctatagaaacaatgacgcccaccaactctcacttgctaagaaagacttcatccacctcttcgtggaggacatcatattctaccaacgcccgctaaagagccaaaaatcctccgtttccaactgcacactagaatgtcgcaaatataaagacaagaacggagaggaacgcatacagttccttaaagtcatccccaagtcaaacccgtactatcaagagttccgcatttggcagtggatgagcaacctgaaaatctacaggcgagacgacgacgtgaacataacctctgaatacctaaagactacagaggactaccaagatttgttcgtcttcctcaatacgcgaaaagaggttgaccagaaagcatgcctaaaacacttcaagttaaacgagaaaactcacagatggaactacgtggaggacaaacggtacccatgcaacgagacgggaaccatgatactggaaagattcaaaaaggtcggagactcggcagacaacatcttcacccgagaaatggagcaacaaatgtggcacatcatctacagcgtcaacgacaaaacagagtacgaaaaagcgctcaaatccttcgccaaaaagaacgacctcgacaacgttagcttcttcgaagccttcaggaagttcccgccattcgactcggaatatggctctttcagcgagaaggcaatcaagaaactgctacccctcatacgaaccggcaaatactggaactgggaggcagtggacgagaaaacaaagaaaagaatacagaaaatgataacaggagaatgggacgaagatataaaagataacatacgcgagaaaaccctatcgctccaaaaagaatcggacttccaaggcctccctctgtggctggcccagtacgccgtatacggcaggcatagcgaggcgtccgtcgcaggcaaatggaactccgtcaatgacatggaagaatacctaaaagagttcaaacaacactcgctgcgcaacccaatcgtagaacaggtcataactgaaaccatccgcgtggtcaaagacatatggattaaatatggcaacggtgcagcggacttctttaacgagatccacatcgaattaggccgagaaatgaaactgccagcaaaagaacgaagcaagatgacccaaaagatttccgaaaacgagaacaccaacctgcgaatcaaagccctgctcgtggaaatgatgaatgatagcgaagtgcacaacgtgcgaccgtactctccaatgcagcaagagatcctgaaaatatacgaagacggtgcactcaactcagaaatctcagtggacgacgacatcctcaagatctctaaaaccgcacaaccgagcccgagcgacttaaagaaatataagctctggctggaacaaaaatacagatcgccgtacactggagacatcatccctctaaataaactcttcaccaccgagtatgaaatcgaacacatcataccgcagtcacgatacttcgacgactcgttcagcaacaaagtaatctgcgagtcgtcagtaaaccgccttaaggacaattacatcggcctaggattcataaaacagttccacggctacaaaatcagcgataagacgaaagtattcgaggtagaggaatacgaagacttcgttaaaaagaactacgcctcaaactggagcaagcgcagcaaactattactcgaagaaataccggaagagatgatcgagcgtcaattaaacgacaccagatacataagcaagtacataagcgggatactctcaaatatagtcaggaaaaaggagaatgacgacggcgtgaacagcaaagacatcatcccaggcaacggcaagataacctcccaactcaaacaagactggggtctcaatgacgtctggaacgatctcgtgctcccccgattcgagaggatgaacgaattaacgaaatccaacgacttcaccgtctggaacgaaaagtatcaaaagttcctcccgacagtgccagtggagttctctaagggcttttccaagaaacgaattgaccataggcaccacgccctcgacgccctagtcatagcgtgcgccacacgggatcatgttaacctgctaaataaccagtcagcccgcagcgaaatgaaaagatacgacctcaaacggaaactgatgaagttcgaaaagaaagcctaccagcactcacaaacaggcgagcgcatcgtcaaagatgtcccggtcgagttcctaaagccgtgggacaatttcatcgttgaagcgaaggaaaacctagatcgcataattgtctcgttcaagcagaacctccgcgtcatcaacaaagcgactaaccactacgagaaatggatcgagaaaaacaacgttaaagtaaaagccctcgtggaacagcaaggactaaactgggccatacggaagcccctccacaaagacacggtgagtggcaaagtcgacctacccgggacaaaggtgcccaagggcaagatcctcaccgccacacgcaagagcatcgacactagcttcgatatgaaaacaataaacagcatcacggacacgggcatacaaaagatcctcaaaaactacctggagtacaaaggcagctatgaagacgcattcagtccagagggaattgaagacatgaacaaaaacatcgaaaagttcaacgacggaaaacaacaccaacccatcatcaaagtcaggatcttcgaactcggatccaagtttccgctgggccagatcggaaacaagaaacacaaatacgtagagacagccaaaggcacaaacctattcttcgctatctacgaagacgacaaaggcaaaaggacttacgagacaatccctctaaacgaagtcatagaacgccaaaaacaaggcctggccccggtcacctttaaaagcaaaaacgacttctacctcagcccaaacgatctagtctacgtagccgcagaaggggaatcggtcgacaacctcgacttccaatccgattcccaagaatacatcaacaacgtatacaaagtcgtcagcttctcagggagtcaaatcttcttcgttaagcagaacgtcgctgtctccatagtcaacaaagcggagttcagcacccttaacaagatggaacgcgcgattgacggccgaatgataaaggagtgttgcgtcaaactgaaaatagaccgcatcggaaacatgaccaaatcttga

SEQ ID NO: 6792 - RNA, 4245 nt, synthetic construct
  misc_feature 1..4245: note = Cas9 variant
  source 1..4245: mol_type = other RNA
atgaagaaaatactcgggctcgacttagggacaaacagcatcggatgggcattcgtagaggaggcagaaaacgaaagtgaaaaatcctccatcatcaaacttggcgttagagtcaaccctttgacagtcgacgaacaacaaaacttcgagaaaggtaaaagcatcacaacaaacgcggaccgcaccctaaaacgcagcatgcgacgcaatctccagcgctacaagcaacgacgggagaacctaatagacatcctcatgaaaaacggtttcacgtccgacgacacaatactttccgagaacgggaaccgcacaacgttcgaaacttaccgtctccgatccaaagccgtagctgagaaaatctccctccaagaatttgcgcgcgtcttactgatgatcaacaagaagcgcggctacaagagtagccgaaaagccaagggaacagaggatggcgagctaatagacgggatggaagtggccaagaaactctacaattacaatctcaccccgggacaactctgcctgcaactcctgaatgaaggcaagaaacatttaccagacttctacagatcagatctccaagcagaatttgaccgaatattcgatatccagatgacgttctatacagagtacctcaccctcgagctcaaagaggaactgcgtggaaagaaacgcgacgccgtgtgggccatttgcgccaaaatattcaaagaaaaaggctttgaactcatcgggaccaaacgccaaggaagtacggcagaacaaaaacatgagaactactcatggcgggccaaaggcctatccgaaaaactcgagctagaacagctagtcgtagtcctccaacagataaacatccagctcaactcatcctcaggctaccttggcgctatcagcgaccgaagtaaagaactctttttcaacaaacaaaccgtcggccaataccaaatggctgtcctcgacaaaaacccaaacgcgggcctacggaacatggtgttttaccgccaagactacctagatgagttcaacgcaatctgggaaaagcaggccctcttccacccaatcctcacggatactctgaaggacgaaatcagagacgtcatcatcttctaccaacgtcgtctcaaatcgcaaaaaggcctaatatccttctgcgaactcgaatcacgcaaaatcgaggtggagatcgcgggacaaaacaaaaccaaaatggtgggcagccgagtaatccctcgttccagccccctattccaagagttcaaaatatggcagtccctaaacaacatcgaagtcttcggaaaagggaaaaagagcaagaagcaaaaagaacagacactgttcgaccagaccgaagatccactcgaatttggaggtcgacgcgaactatatgaagaagagaaagaactactcgccctagaactctccatcaagaaagagctcaagaaagccgacatactcaaactactcttcgacaaccccaaagagctcgatctcaactttaacgcggtccaggggaacctaacccaggctacactcttcaacgtctacaagaaaatcatcgagctcagcggtcacgaaatcgacgtggagaaagactctgcaagcaaaatacttaaatctatcgaagagatcttcaaggcgcttaactacaacaccgaaatactccatttcgacagtgaaaaatctcaagaccaacaggctatgtacatgctatggcacctcctctactcatttgagggagataacagcaacaccggcaacgaaaatctaatcaacaaaatatctaaactatacggcttcgaaaaggagtacgccaaaatcctcgccaacgtatcattccaggacgattatggtagcctctcggcaaaagccatctcgaagatactcccgtacctcaaagagggacataaaagcgacatagcctgcgacctcgcgggctacaaacacagcgcttcctcgctcactcgagaggaactcgagaacaagacgtacaaagacagactcgagatcctaccgaaaaacacactccggaacccagtcgttgagaaaatcctcaaccaaatgattaacgtcataaacctcatcatcgacagccgagaactcaagaaaagcgccaaagaacgcgaagaactaacaaaatccataagcgaaaccacaaaactccaccagcaatacaaagacatcctcgcaaaggccccatttaaccttacaaacacctcccgtaacgatatcatacgctacaaattatacgaggaactcaaagacaacggctataaaacgctctactcaaacaagtacatatcccccgcagcacttttcagcggcgatttcgacatagaacatatcatcccacaatcacgcctatttgacgactcattctcgaacaaaacgctcgagctccgttcaatcaacatagaaaaggggaacaagaccgcatacgacttcatcaaagggaaatacggggaaaccggcgaagataactgtctggacaagtacctcaacagaatcgaaaccctgtacaagaacggaatacttaaaaagtccaaatacaacaaactaaaaatgcaagacaaggatatcccagacggcttcatcgagagagatatccgcgacacacagtacatcgccaaatacgcaaaaacactcctaggggacctcgtcaaattcgtcgtcagcacatcaggttccgtcacggaacgcctacgagaagactggcagctagtcgatgtaatgaaggaactcaactgggaaaagtatatgcaactcgggctaactgaggagttcaccaatgaagagggacaccgaatccggaagattaaggactggaccaaacgcaacgatcaccgacaccacgcaatggacgccttaacggtcgcgtttacaaaacgccaatttatccaatacctaaacaaccttaacgcaaggagaatctcagacgaacaaggcatctctaactctgagaaggacgaacgcaacaacgtcagcattaccacgaacgacatgaagctaaatacccgagacgtcctgggtatcgaaaagaaagaactctaccgcgacaacagaggcaaactacgtttcaaggcaccaatgccactcctggagttccgagaagaagctaagagacatctcgaaaacacactaatatcaatcaaagcgaaaaacaaagtcacaacgatcaacattaacacgctcaaaaaggcaggaggtgtttacaagaagactcaactcacaccgcgggggcaactccacaatgaaaccatctacggctcacagaaacaatacatcgtcaaggaagagaccataaacgctaagttcgatgtcgagaaaatagcaaccgtcacaaaccccgtctaccgcgaagctctcctgaaaaggcttgaacaaaacaacaacgatcccaagaaagcctttacagggagcaacgcgctcaccaagaaaccaatgtggttcgacgagcaacagaccgaaaaagtaccagagaaagtcaaaactgtatcattcgagacaatctataccatccgaaaggaaatcagccccgaccttaaaattgaaaaagtcgtggacgaaaaggtacgacaaatcctcaacaacagactcaacgaatacaatggcaatgctaagcaggcattctccaatctagacgaaaaccctatatggctaaacaaggagaaaggcataacaattaagcgagtaaccataactgggataaacaatgcccaggcgctccacgaaaaactggacaaagacgggaaaccaatcctcgacggcgagggaaagaaacaaccggtcgacttcgtcaacactggaaacaaccatcacgtagccgtctactgcgacgcagacggtaatctccaggaaaacgtcatttcattctacgaagccgtaacccgccgcaacctgggacttcccatcattgacaaagactacaagaaagatgacggctggcagttcctcttcagcatgaaacaaaacgagtatttcgtgttccccaacgaaagcacagggttcaaccccaacgaagtagatttactaaacccggataactatagcctcataagcccgaacctcttccgagtacaaaaattcaccattaaggactacttcttccgccatcacctcgagacgaacgtcgaatcgaactcaacccttaaaggaatcacctggctgcgctgcggactaaacaacatagacaacatcatcaaagtccgtataaaccacatcggccaaatcatacacgtaggcgagtactga

SEQ ID NO: 6793 - RNA, 4248 nt, synthetic construct
  misc_feature 1..4248: note = Cas9 variant
  source 1..4248: mol_type = other RNA
atggcgaaatttaacaaaccctacagcatcgggctagacatcggcgtctcctcagtcgggtacgccgtaatcacggaggactaccgcgtccccgccttccgcttcaaagtccttggaaatacagagaaagagaaaataaagaaaaacctaataggttccaccacctttgtccccgcccagagcgcacaagtcacccgcgtattcagagtgaaccgccgccgcattgacaggcgcaaccaccgtatcgcgtacttacgcgatatcttccagaaagagatcgagaaagtcgacaaaaacttctaccgcagactggacgagtcgttccgagtcttgggcgacaagtctgaggacctgcaaatcaaacaacccttcttcggggacaaagaactagaaacggcctaccacaagaaatacccaacaatctatcaccttcggaaacacctagccgacgcagacaaaaactccccggtcgcggatatacgcgaagtatacatggcgctttcccacatacttaaatatagaggccacttcctcaccctcgacaagataaacccaaacaacatcaacatgcaaaactcatggataaacttcatcgagtcgtgccaagaagtcttcgacctcgaagtatccgaggagagcaaaaccatcgcggccatcttcaaatcctcggaaaacagacaagagaaggtcaaacaaatcttgtcctactttcaacaagaactactaaagaaagacaaatccatattcaaacagctcctgcaactactcttcggcctcaaaacgaaattcaaagattgcttcgaacttgaggaggaacccgacttaaatttctctaaagaaaattacgacgagaacctcgagaacctactcggcacactcgaggaggacttctccgacgtctttgccaaactgaaaatactccgagacacgatcctgctatcagatatgctaacctacactggcgccacacacgcaagattctccgccaccatggtcgagcggtacgaggaacatcgcaaagacctacaacgtttcaaatctttcgtaaagcagaacttatcggaacaggactacttggacatcttcggacgtaaaaccccaaacggcttcgacgttgacaaagagacaaagggctacgtgggctatataagcaacaagatggtattaacaaataaacaaaagaccatccaacaaaacttttacgactacatctccggaaagatcaccggaatagaaggagctgaatacttcctcaacaagatttcggatggaaccttcctccgcaaactacgcaccacagataacggggccatacccaaccagatccacgcttacgaacttgagaaaataatcgaaaggcaaggacgggactatccattcctactagaaaacaaagacaagctcttgtcaattcttaccttcaagatcccctactacgtcggacccctcgcaaagggcaacaactcgcgcttcgcttggatcaaacgcgccacaagccaggacatacttgacgacaacgacgaagatactcgtaacggaaaaatccgaccctggaactatcacaaacttataaacatggacaagacgcgggacgctttcatcacgaacctgataggaaacgacatcattttactaaatgaaaaggtcctgccgaaacggagcctaatctacgaagaagtcatgctccaaaacgaattaacccgagtcaagtacaaggacaagtacggcaagacacacttcttcgacagtgaactccgccaagaaatcataaacaacctcttcaaaaccaactcaaagcgagtcagctcggcaatgctactcaactacctagaaaactacaccaacctacaggccgttgaaatagtgtctggaatcgagaaaggaaagtccctcaactccactctgaaaacctataatgacctcaaaaccattttctcagaggaacttctcgactccgaaatctatcaaaaagagctcgaggaaatagtgaaagtcataacagtattcgacgacaaaaagagcataaagaactatctaaccaaatatttcggacgcctcgagttcctcaacgaagaaaggatcaaccaactcagcaaactccggtacacaggctggggcaggtatagcgcaaaactcctcctagacatcagggacgaagacaccggattcaacctcatgcaattcctccgaaacgacgacgagaacaggaacttgtcacaactgatatccgactcaacactctcattcgacagcgccattaagtcgatacaatcaaagagcacggtggaagacgacgtattcgacgaaataaagaaactagcggggtcccccgccatcaaacgcggtatccttaacagcataaaaattgttgacgaactggtacaaataatcgggtatcccccgcaaaacatcgtaatcgaaatggcaagagagaacatgacaacagaagaaggccagaagaaagccaaaacgcgtaaaacaaaactagaaagcgccctcaaaaacatcgaaaacagtgtgttagagaacggcaaagtaccccacagcgacgagcaactccagtccgaaaaactctacctctactacctccaaaacggcaaagatatgtactccttggataaaaccgggtcaccaacaccactgtaccgtgatcggctagaccaatacgaagtcgaccacatcatcccctacagcttcctaccaatagactcaatagataacaaagtacttacccaccgtgaaaacaaccagcgcaaacttaacaacatccccgacaaagaaaccgtggccaacatgaaacccttctgggagaaactctacaacgcaaaactcatcagccagaccaaataccaacgactcactacatctgagcgtacgcccgacggagtgctcacagaatcgatgaaagccggattcatcgaaaggcagctagtcgagacccgacaaatcataaaacacgtcgcacgcatcctggacaatcgattccttgacaccaaaatcattacactcaaatcacaactcatcacgaacttccggaacacattccacatcgccaagataagagaactcaatgactaccaccacgcccatgacgcctacctagctgtcgtcataggccaaaccctactgaaagcgtaccccaaattagcccccgaactaatctacggccaccacgctcacttcaaccggcacgaagagaacaaagcgaccattcgcaagcacctctactccaacataatgcgcttcttcaataacccaaactcaaaagtatcgaaagacatctggaactgcaaccgcgacctccccatcataaaagacatcatatataactcccaggtcaactttgtgaaaaggaccatgatcaagaaaggcgccttctacaaacaaaacataatacccaatgattcgtcggttacagtcgacaaacggttcccgatcaaaaacaagaaatacctggaccccaaactatacggaggctactacgaacgaaactcagccctcagcgtattcataatagggcagtcctttaacaaaaacaacaaactaaaagtggtaaaagagttctacgatatcaacatcatcgactaccccctcttcaacaccgacccgatgagcttcttcaacgacgactctgaaaacggcttcctcactaaaaacaacctacaatccgtacaagcgttctacaaaatccccaaatactccctaatccagaaaaacgacggcacaagaatgctattcgaaagcacaacaaacttccacaaagccacacaatttaaactcaccgaggctcagaacgaactcttcttccacatgaaacgtctattaacgaaaaccgacttcatggacctgaaaagcgaagaatccatcaaagagagtcaagacttcatcatgaatcataagaatgagttcgacaatatagtcaatggactcttcgggtacgcagaacgccaactagggagcaaatccctcttcacacaagcacacgaggcttacaaactacgcaaataccccgtgttcagcctcaacgaggagacgatacgatactattacgataatttccttcgactcttctccctcaccaaatcaggcactagctcgggctacgttgtaggtctattcgaagccccaaaactcagaaacgtagtgtaccgggcaaccaaagatgagagcaacgcgacactcatccatcaatccatcaccggcctctacgagactcgaatcgacctgagtaagctaggcgaggattga

SEQ ID NO: 6794 - RNA, 4248 nt, synthetic construct
  misc_feature 1..4248: note = Cas9 variant
  source 1..4248: mol_type = other RNA
atgaacctgcgcaacgttgccaaagagggaataaactataatatcggcctggacctagggacaggttcggtgggatgggctgtgacagacgagcagggcgaactattctcgttcaaaggtaaaactacctggggaagcaggatattcccaaccgctgaaaccgcagcagacaccagactcaagcgcggccagcgacggcgatacgccaggcgcagatggagactagacctcctacagagcctattcgaagaggaaatcaagaaagtagaccccgagttcttcacgagactaagacaaagccacctactaaaggaagacaagacatacgctgccatcctatcaagcaagggcgccacacgcccgctatttcctgaaggcgaagccgaagtcgaatactacaagaaatatcccacaatataccatctccgcaaagccctaatggaatcgaacaaccaagaagacatccgacttatctacctggccttccacaacatcgtaaaagcacgaggaaacttcctccaccaagacaccccgggactcacggcaagcaatgcaaacatgggcgacgccgtagaaaagctctgctctgcgctagaagactggtgctcaagccaaaacatagaatgcgcgatcaggaaaaaccagaaaagcattcaagacctaatggaaggcaaaaccatcgaacccagcgagtcaaacgcactgaaagagacgttcgacgcaagcagatcttcgaggaaagataaagccagcgtgctagcaggatggattgccatacaaccaggagagcaatttgaacccaaacaggcaaaagatgcatcaaaagagatcgcaaacgctgtcttcggcctcagtgcgaacatgaagaaagtatttgtagagctcgaggaggaccagaaaatctacctaaacaacgatgagcaagtcgaggccttctatacggtgtgccccgacgaaggagtcgcgctgttcgaagcactgcagagcatgtactccgcgtacgtgctgatgggcatattaaaaggagcggacggcggatctatcagcagctgtaaggtagcggcctacgaacaatacaaagaggacctcaaactactcaagacgctggtccgcgagttcgcgcccaagaaatacgacgagttcttcagaggcgacatattcgatgcgaaaaagggcttccggacgagaaactacgaccccgccacggcaaagggatataccaaatacaatagcgtaagaggggcctcatacgacgcattcaaaaaggaagtggaaaaattattcgagggcaccgccgctgaagaagacgtccgatacacggacatgatgcaacgattcgacgaaggaaccttcctccgcagactaaagaccagcgacaacggcagcatcccatatcaactgcacctagaggagatggttgcgatcatagaaaaccaaaagacattttaccccttcctcgaagaaaacaaagagaaattcgaatcgctagtaacatttcgcatcccctactacgtgggcccactcacccagaaaaacgctagacccgacaaccacggcaacgccagattcgcctggagccaacgcaaagagggacaagaaaacgcgcgcgtatacccgtggaattgggaggaggtaatcgaccgcaaacaaagcgccgccaagttcatggagcgcctaacgggcacatgcacatacatactagaggaaccagtactgccgcgttattccctcctctacgaggaatactgcctcctcaacgaactgaatggggcccgatggcgggacatgggcggtgattggcacaggttcgactacgaaacccgcatggatataatagaggacctcttcaaaaagaagaaaggtaccgtaaaatacgcaacagtcgcagactggctcgtacgcgagaaacaccgatcctgcgccgaggtgaaagggggacaaggagagacaggattcgaatcgaaactctcgagctacgtcttcttcaagggcgtcctgcatgtggatgagatagacgaagcagacatcccgatgatcgaagaactcatatggtggaacactctcttcgaagacagatccatactcaaagagtcaatcgaggacaaatacggagaccggctcaatgatgagcaaatcaaagccatatgtaagaaacgattcactgggtgggggcggctaagcaaaaagctactatgcggcatcaaagcgcagacagacaacggcccttgcagcataatggacgtactgcgcgaaggaaacccaaacaacgacgcaagaagcgccacaatggtattcatggagatcatcagagatgacaaattcggattcacaaaactaatcgaagaagaaaacaagaagaggatcagcagcgtggacgacttcgacgtcaacgatcttccgggaagcccagccgtaaggaggaccgtaaaccaggccaaaaggatcgtcgacgagatcgtcggcatcgcaggctgtgcgcctcagaacatattcatagaagtcacaagagatgaggacggaagaaacaaaggaagacgcacgaaaagaagatacgacgccatacaagaggcagtaaaggtattgaagaaagaacagaaggagtactttgatgccaacgtagctgacctcctcaaaaacacagccccagcagcgctcgacgacgaaaggctcgcactgtacttcatgcaaaacggaaaatgcatgtactgcggaaaggacctggacatcaaccagctcgacaaataccaggttgaccacatcctcccccagagttacgtcaaagacgactccttcgagaacaaagccctcgtccactcggacgacaatcaacgcaagagcaacagcatgctactcgacgatagcatcattagaaaaatgaaaccatactgggaagccctgcgaagcgccggtttgattggtgagaaaaagttcaagaacctaacccgagtgcgtgtctctgacaaagaactaggcgggttcatcgccaggcaaatggtcgaaacgtcccaaagtatgaaactgacctctctcctcctagaacaagcctaccccgaaacgcaggtccgccctgtaaaagccggcttcagctccgatctgagacgccgactcaagctggtgaagtgcagagaaataaacgactaccaccatgctcacgacgcgtaccttgcctgcgaggtaggccagttcatagcactcagacacaacaagctgtacgaaaacccgatagggtacagtcacgcagtaaaagacttcatcgcaaaaagagcgaaatacgccagcgagcatggtaaacccatggatacctacggaatgcccggaagctccagcttcgtcatcagcagcttcatgaccagcggcttcgacgaggagactggagaaatattcaaagatgcgtgggacgcaagcctcgcggccgtccggatccaccaagcgctcaaccgaaaagattgttatatctccagaatgcccgaagaaacctccggagcgttctgggacgcaacaatatacagcccaaaacaaaccaaaaagaaactctcgctgcctctcaaaaagggtctggacccgcaaaagtatgggtcctactcacgggaacagttcgcctacttcttcgtgtacgaggcgaagaaaatcaaaaagaaagaagagacaaaggaatatgtgtttgcgtctgtgcccgtccaagtcgcggcgctagtcgcagcagaccccaacgcactaatagagttcgccaaagccgacgccgaagaaagaggactgaaattcgccaaaatcgtccgagaaaaagtctacaagtaccaactcatcgaagtaaacgatgaaagatttttcgttaccggcttgcgaacagtacgcaacggcctccaaatcgcctttagcgaacaagatcggaatatcgtgagcggaatcgtagaaggcaacagctcaaacaacaacctcctagatatctacgacaaaattacaaatcgatacgcactctacgcatccagattcggcaagctgttaaacctctcgggctacagggagaactttatccaggcgagcctggaggaccaagaaagagtcgtgctcgccctaatcagtctcttcaacgcacggaccaacatgatagatctctcggcaataggcagcagcaaaacggtgggcaacatgtctatgacatttgcgaaagaaatggcaatggcagacaaccgattcgccttcatagaccagtcggtaaccggcatgcttgaacgaaagacatacctatga

SEQ ID NO: 6795 - RNA, 4251 nt, synthetic construct
  misc_feature 1..4251: note = Cas9 variant
  source 1..4251: mol_type = other RNA
atgggatcacgcatcatacccatgagccaagacatactcggtgagttcggtaaagggaatagcgtctctcaaacatcagaacgtacagcgtaccggagcacccgccggctgcgcgaacggttcctcctccgacgagaacgccttcaccgcgtgctaaacatcctcgacttcctgccaactcactacgcgagccaaatcgacttcaagaaacgacttggcaagttcaaagaaaataaagaacccaagatagcgtatgacaacaagtcattcctattcctcgatagcttcaacgaaatgcttaaggacttcgagcaagagcaaccaaacatgctcatcaacgagaaaggagagaagaaactaatcccatacgactggaccctatactaccttcgcaagaaagcgctcagagagaaaatctccaaagaagaactcagttggataatcctcaacttcaaccaaaaacgtggctactaccaactccggggagaagacgaagaggagaacccctcaaaactggtcgagttccactcactcacagtcgtcgacgtggtcccagacgagcccataaaaggcaaactcgaaacatggtactctatcatcctcgacaacggctgggtctacaggcgcagctcgaagactgagctctacgactggaaggacaaaatcaaagagttcatcgtgacgacggacctaaactacgatggcacagttaagacagacaaggaaggcaacgtaaaacgatcgttccgcgcgccttccgagacggattggacactaataaagaagaaaacagaatacgaaatagaacagtccagcaaaacaattggcgagtacatctataatacgctcctcaaataccccgaacaaaagatacgcggcaaactaatccggaccatagaaagaaagtactacaaggaggaactgaaacagatcctcctcaaacaaacagagttccataatgaactaaaagacgacagcctatactacgactgcttgcgcgaactctaccgaaacaacgaaagccaccaactattcctggaaaagaaaaacttcgcacaattattcatcgaagatataatcttctaccagaggcccctccgaagccagaaatccctcatttccaactgccccctcgagttctacaaatttaaagactcagtcggcaatgagaaagtacaacacctcaaagctataccgaaaagcaaccctttctaccaagagtttcgcatctggcagtggatatccaatctctccatctacagcaaactcgacgatagcaatttcacaagccacttcttcgactccaccgacgactgggagagccttttcgaaatgcttaatggacgaaaagagatagagcagaagcaactcctaaaatttctactggagaaaaaggggttcaaggggaaaagcctcagcagcgaaatcgagaaatatcgctggaactatgtagaagacaaaaagtacccctgcaacgaaactcggtccctgatccagtcacgactagacaaagtcgccaatctaccagaatccttccttacacgccatgtagaacaggaactatggcacctcatctactcggtaactgacaagatcgagttcgaaaaggccctggacacgttctctaagaaatacaagatcgacacaccgacctttgtggacgcattcaaaaagtgccctcccttcaagagcgagtacgggagtttctcagaaaaggccatcaagaaactgctccccctcatgcgcacgggaaaatactgggaccttgacaacatcgacaaagctaccaaacaacgcatcgagaaaattatctccggcgaatacgataaagacataagggaccgcgtacgtgaaaaagccattaacctactaagcgaaaccgactttaaccgtctgcagctctggctcgcccaatacatagtatacgacagacactcagaagccaccagtctggataagtgggagaccatcgacgacattgtaacctatctgcactccttcaagcaacacagcctaagaaaccccatcgtagagcaagtcataaccgaaaccatccgggtcgtcaaagacatctggtcaaactacggaaacggctcgaaggattacttcaacgaaatccacgtcgagttaggacgagagatgaaactccccgctgaggaacgcaaaaggatccaagagaaaaacagccaaaacgaagacacgaacctccgaataaaggccctcctcagcgaaatgcaaaacgacccgaatgtggagaacgtacgcccatactcccccgtccaacaagaaatcctgaaaatttatgaagagggcgtactgaactccaacattgaaatcgccgacgacattctcaagatcagcaaaaccgcccagccaagcagcagcgacttaaagaggtacaagctctggctcgagcaaaaatatcaaagcccatacacaggcgaaataattcccctcaacaaactcttcacacctgaatacgaaattgaacacataatccctcaatcacgctacttcgacgattcgtataacaataaagtgatctgtgaaagcgccgtcaacaaactaaaagacaactccttagggtacgagttcatcaaaggatacaacggccaaatagtagaatgcgggtttgggaagaaagtcaaaatattctcgattgacgaatacgaggacttcgtacagaaaaattacgcgaataatcgcagcaaggcatcacgcctgatgatggccgacatacccgaaaagatgatcgaacgacaactcaacgacacgcggtacatctccaaatacataagcaacatcctaagcaacatcgtaagaagcgaatcaaacgacgacggcgtaaacagcaagaacctcatatccgtaaacggtaagatcacaaccgtacttaagaaagattggggcatgaacgatatatggaacgacctcatcctaccccgctttatcaggatgaaccagataactgattcagactccttcacaacatggaatgaaagattccagaaattcatcccaaccgtccccatcgagctgtctaagaacttcagcgccaagagaatcgaccatcgccatcacgccatggatgccctagtaattgcctgcgctactcgggaccacgtaaacctcctcaacaacctgtacgccaagtcatcagcacgctacgacctgaaccgaaaactgagaatattcgaaaagacgacatataaggacatcaagaccggccagataatagagagagaaataccaaaagcattcctaaagccatggcaaaacttcacaaccgacgcaaaggacgccatagagagtataatcgtatcctacaagcaatcactcagagtaataaacaagagtaccaactactaccaaaaatgggtcgagaaggacgggatagtcaaaaaggagaaaataaaacaagaaggaaagaattgggcgatccgaaaacctctccacaaggacacggtatccggcctagtccaactgtcctgggtcaaagtgccaaagggaaaagtcatgacagccacacgtaaatccctcgacagctccttcgacctaaagaccatcgcgacgataaccgatacaggcatccagaaaatcctcatcaaatatctggaatcgaaaggcaacaacccggaatcagccttctccccggaagggatcgaagacttcaacaacaacatccacctctataacgacggaaagaaacatcggcctatcaccaaagtgagactgtacgaaattgggtcgaaatttcccctcggcgaaaaaggcaacaagaacgccaaatatgtggaagccgctaaaggcacaaacctgttcttcgcagtctatgcaaataacaagggcgagcgttcgttcgaaacaatcccactaaacctcgtcattgaccgattaaagctcgggctcagcgcagtcccagaaaccaacgaaaagggagataacctccttttccacctatcccccaacgacctcgtctacgtgccctccgaggacgaaatggagaacctgaagctgatcaacctcgaacacatatccaaggaccaactaaaccgaatctacaaaatggtcagctcaacgtccaaccgctgcttctttatcaaatctgaaatcgctttatccatcgtcaataaaatcgaatactccccactcaacaaaatggaaaaatccatcgaagggataatgatcaaagacgtatgcctaaagctacaggtcaaccgcataggcaacctagagcggtacttcagctga

SEQ ID NO: 6796 - RNA, 4257 nt, synthetic construct
  misc_feature 1..4257: note = Cas9 variant
  source 1..4257: mol_type = other RNA
atgaaagtcaaaaacatactaggattagacatcggcgtaacatcgataggtttcgcccacgtaacagaaaacgaaaaagacaataaaagccatataaagcaactaggcgtacgaatcaacccgctgaccgtcgacgaacaaactaacttcgaaaaaggacgcccagcatcagtcaacgccgaccggacactaaagcgcggagccaggaagatgctatcccgatataaagaccggcgcaagaacctcatcgaaatcctatccaaaactggcttcatcaacagcgaatcgatactggccgaggacggcaaaaacacaacccattccacgtgggccctcagagccaaggccagccgggaacgcatagagaaagacgagctcgggcgcgttctccttgctataaacaagaaacgtgggtacaaatcgtcccgaaaagccaaaaacgaagacgaaggccaggcaatagacggaatggccatcgccaagcgcctatacgaagagaacctcacccccggccaactcgtttatcagctgctacgggagggcaaaaagtatatccccgatttctacagatccgatctccaagacgagctagacaaagtgtggaacttccaaaagcaatttcaccaagaaatccttaccgacacgttctacaaagacatacaaggcaaaggacaacgcgcgacctcggccagcttctacggagtctacggcttcaacacagccgaaaacaaagggtcccgcgaagagaaaagactacaggcctacgcctggcgaagcgacgcgctcacgaaacagctcactcgcgaagaggtcgcgttcgtgataacagagatcaacaataacctcaataacagcagtggctatctaggagcaatttccgacagaagcaaagaactgttctttaacaagaaaaccgtcgggcagtacctatacgaacaacttcagcagaacccgcacacaaggctcaaaaaccaggtattttaccggcaagattacctagacgagttcgaaacgatatggaccatccagtcccgatactaccctgaactgaccgacgaccttaaacgcgaaattcgggacgtagtaatattctaccaacgtaaacttaaaagtcagaagggcttagtttcattctgcgagttagaaagcaaagaaatcatgatcgaaaagaacgggaaagccgcagtaaagaaaattggctccaaggtagcacctaaatcatcacccctatttcaggagttcaaaatttggcaagtactccacaacgtcgatatcaaaaacaagaaggacaagacaaagcgcccgctagacgacagcgaaaaagaatatctattcaacgaactcaacataaagggcaacctaaaagctgcaaaggttatacaactcctcaccctaaacaaaaatgaaaccgaactaaactacacccagttggaaggaaatagaacccagaaagcactctacgaagcatatctaaaaatactggataccgaaggctacgacgttaataacctcctcgggatcaagtcgaacaaagacgaagtattcctcgacgacttggacgtaaacgcgctggagataaaaacgatgatcaagcaaatcttcaacgccctcaatatcaataccggcatcctcgactttgacgccgagctagacgggaaagccttcgagcagcaagcctcataccacctatggcatctgctatactcctacgaagaagacggaagtaagagcggcaacgaacacctctacaaactcctcgaaaacaagtttggcttcaagccagagcacgcgcgcatcctcgcggggataaccctctccgacgactacggcaacctaagcgccaaagcaatgcgcaaaatttatccccagatcaaagagaacaacttcagtacagcctgcgaactcgtcggctaccgccacagcaaaaacagcctcacaaaagaagaaaaccaagagagaccactcaaaaacaagctcgaactgcttaagaaaaactcgctacgccaacctgtcgtcgaaaagattctcaaccaaatgataaacttagtgaatgagctaatagacaaaaactccgagaaagacgaacaaggatccattatcgaatacttccgcttcgacgagatcagaatagaactagcccgagaacttaagaaaaacacagacgagagacgggacctagacgctgcgatccgagaaggtaacctccgcaacgaaaagatatacaaactcttgcaagctcaattcggcatcaaaaacccaacacgaaacgacatcatacgctaccgcctctacgaggagctcaaaaacaacgggtacaaggatctatataccaacagctacatcccccaggagaagctatttgggaaagaaatcgatatagaccacatcatcccacaatcaaaactattcgatgactcgttcagcaacaaaaccctcacatataacacaacgaacaaggacaagggtaaccaaaccggattcgactacatcgagtcgaaatatggaatagacggaatagaagcatacaccgcgcgcatagaaaacctcttcgagagcggaaagaaaaacaaagaagagggcgttagcaaagcaaagtaccaaaagttactgaagaaagagtcagaaatcggcgatggtttcatagaaagagacctgcgtgaaagccagtacatcgcaaagaaagctaaagaactcctcctgcagatcacccggtccgtagttgcgacatccggcagcataacagcccggctacgggaagactgggacctcgtgaacgtcatgaaggaactcaacctaccaaagtaccgcgccctcggccttacagaaatggaggaacgtaaatacggccagaaggtcgaagtaataaaggactggacgaaacgcgacgaccaccgccaccacgcaatggacgccctcaccatcgccttcaccaaacacaaccacatccagtacctaaatcacctaaacgcacgcaaggacgaacaacacaaggaacacaagataatcaacgcaatagagaacaaagaaaccatcctaatcacagacaagtcaggaaatcgaaaaagggtattcaaagcccccatgcccaacttcagacagacagccaaacaatatctggaagaagtactcatcagccacaaagcaaagaataaggtcgtgacaaagaacaagaacaaaattctagggaaagagaaaatacaggaaacgctgacaccacgcggccagctccacgaccagactatctacgggttcaactggtggtctagaatcacattgtcaaagaaagtaagccggaacgagatcgagaaaatcatagacaacaacacgaaattcttcctccaagagttcatccaactgaaaggaagcatcgcaaaggccttcagcgacgcagaactaaacaaactaatgtacaaggggaaaatattgaaagaaatcgaggtggcgattccatgctacactcagcgcatcgatatctccaaagttttcacggactcgcaaaaatcaaactccgcaaaagagaaaaacattaaaaacatactcgacctgaaggtaagaaacatccttcagaatcgcctctccgagttcaaaggcgacttcaaaaaggccttctcggacctcgacaagaatcctatatggttcaacaaggaaaaaggtatctcgatcaagcgcgtgatcatatcaggagtgaagaacgtggaaccgttgcactacaagaaagaccacctaggcaacgacatactcgacggcaaagaaaatagaatcccggtggacttcatcagcacaggaaacaaccaccacgtagctatatatcaggatgaaaaaggcaacctccaagaaaaggtagtctccctcttcgacgcagtaaagctcgtgaacgccgatgaacccgtaatagacaagacttacaatcagggcctggggtggcaattcctattcactatgaagcaaaatgaaatgttcgtattcccgaacgataacacgggattcgaccccaaagaaatagacctccttgacccgagcaacaaaaagctcatctcgccaaacctcttcagggtacaatcaatcagtatagtgcaatacgggaacaacatcgtcagggacttcaaattccgcaaccacttagaaagcgtcctcaacgacgacaaagtccttcacggcataacattccaacaaatcaagagccttggcccgctgctaaacatagtgaaagtcagaattaaccacctcggcgacatcgtgtccgtaggcgaatactga

SEQ ID NO: 6797 - RNA, 4260 nt, synthetic construct
  misc_feature 1..4260: note = Cas9 variant
  source 1..4260: mol_type = other RNA
atggccaagccacaaaactacaccatcggattagacatcggaaccaactcggttgggtggacagtaacagacgaccaaaacaacatcctacgaatcaaaagcaaaaaggccatcggcgccagattattcgaagagggaaaggtcgccgccgagagacgttcattccgtaccacgcgacgcagattatcgcgcagaaaatggcgaataaaactacttgaagaattattcgacgaggaaatctcgaaggtcgacccgaacttcttcgcccgatcgcacgaatcctggatatcccccaaagacaaacgagagcgctacagcgccatcgttttccccacccccgaagaggacaaaaagttccacaacgagtaccccacaatataccatctcagagaccggctgatgaaagatgaccaaaaacacgacatccgagagatttacgttgcaatacatcacatcatgaaatacagggggaacttcctccacgatgaatcaatagagacctaccgcagcggcatgagcagtctcggaggtggcgacgaacgaaccatattgaacacgaagatactcgatgacctgaacgacgcattcgcggacaacctagccacccagggaatatccgtcaacagcgcatcggccgaccagataaacgaaatagtgaccagcggccacctcaatgtcgacagtcaaaaggcgatcgcgaagctacttctccccacgactctctcgagcgatgacaagaaacaggacaagaaaattaagaaactggccacagacgcagcgaaaaacgtagcgagcgcatggctcggctacaaagccaacttcgccgcaatactcaatatccaagaagtcgacaaagataaaaagaaaatctactcatttgcgctacaaggggccgacgaagaggacaaagtcgagaccctcgagtccgttctgtcccaagaccaaatagagatcgtggaccggatcatccgtatacgccatgcgatcgtgctaggcgagatcatccccgtaggcatgacactcagcgaggcaatgattgaaaaatacgaccaacacgccaaagacctgaaaaacctcaaaacggtcatacgaaacctcaaagatcggaaaaatgcggtcaagctgcaagccatctacgatctgtacgtaaacaaccgtcacgccgacacagcaaaggcaatgaaactggcaggcgtcaaaaagcgaactgaacttctggaaccggaagagttcaacaaatccatagaaaaactactagacgactccccagtcagtgccgaaatcaagaaacgcatcgctgaaaaagacttccttcccctccaacgatcaaacagcaacggtgtcatcccgaaccaacttcaccaaatcgaactagacgaaataataaagaaacaatcaaaatactaccccttcctgggggaaaccaatgaacacgcctccgccgatgtcgcccgcaaagcgcccaccaaactcgatcaactactaacgttcagggtgccttactacgtgggacccctaatcactaaagaggaacaagaagaacaagacggccactcatttgcatggatgatccgcaaaaaccccaaagaccacgagaaaatcacaccctggaactttgacgaaaaagtagacaggatggcgtccgccacacaattcataaaaaggatgaccactaaagacacctacttacttggtgaagacgttctcccatcgtcctcacttaaataccagctgttcacagttctgaacgagctgaataacctgcgcataaaccacaaaaagctcacgcgagaggaaaaagaacaagtaattgaagacctcttcaagaaatacaaaaccgtgaaggcggataagttcaaaaactactggcaaaaaggccacgccggcctcgacgtaaagatacaaggcatggccgaccctgagaagttcaacagcacaatgtcgacgtatatcgacctgcaaaagatatttggagaccagctggacgacgcccagagacaaaacgacttcgagaagataatcgaatacagcacaattttcgaagacaggaaaatcctcggggaaaaacttcgagccgacttcgtatggcttagcgaggatcaaatcaaaaggctctgcagactgagacttcaaggatggggacgcctctccctcaagctccttactaggctaaccgatgccgatggacagaacgtcctcgagcgactcctaaactccaatgacaatttcatgcagattgtcaaggaccctgtcataaaagccaagatcgaacagaaaaaccaaaagctgctccgcgccgattggagcgaaaacgcaacagaatccatcctcgacgaagcgtatacctcgccccaaaacaaaaaggccatccgccaggtcatgcgcgtcgtccatgatatcgtaaaagcctgcgacggaaacctgcccgcaaaattcgcaatcgagtttgcccgatcacaggacgacgaccccaaacgaaccgttgcacgagcggaccggctccagaaaatctacgcgcaaattagtgacgaagtcgtcagccaaggagtaaaagatcaactaagcggcatgaagtcactcaaggaccgatattacctctatttcatgcaaggagggcgtgacgcgtacacagggaaacccctcaacatagacagactgtccgattacgacatagaccacatcatgccgcaatcattcatcaaagacgacagcctggacaaccgagtactcgtcacacgtgccgtgaacaaccaaaagagcgacaatgtcccggtactcctatatggaaaccacctagtcgccgacttaggcatcaccatccgtgaaatgtgggaccgctggcaaaaatccggaatgatcagtaagcgaaagctagccaacctactaacggaccccgccaccctcagcgagtacagggctgaaggattcataaaccgtcaactcgtcgaaacaagccaagtgatcaaactcaccgcaaccatcttacagagcgagttccccgatagcaaaatcatagaagtgccagccaagtacaattccatcctccgaaagcagttcgacctctataagtcaagggaagtcaacgactaccaccacgcaattgacgcatacctgtcgacaatagtcggaaactatttataccaagtctatcccaacttacgccgcctctttgtatacggcgagttcaaaaagttctcgcacggggaagaagaatcatcccaccaagccgtcagacgggtcaagagcatgaacttcctagacgacctactccgtgggaaacacggcgacgacatctattgccgtgttaccggcgaagtaatcttctcgagaaaagacatcataagcaaactgaaacaagcgtatagcttcaaacaaatgctcgtaacacaggaagtgtttacgaagaaatctgctctcttcgaccaaaccgtgtacccatctcccgcccgggacagcaaaacccgaagcggactcatcccccgaaaacaaggcatggatacagagatatacggcggttactcaggaaacaaagacgcctacttcgtgctcgcacaagtagtcaagagcaagggccacaccttacaagtagttggtgtccctatacgtgcgctcagagctctagccaactgctccaactacagcgaacagctactcaagattgttaaggcccaagtcctattcaacaagaaaaccgggaaagcgaagaaaggcatttccgacgtccgcatccttctagacaaaatcccctatcggcaacccgtcctagacggtagcgccttctacatgctagggagttccacatacaaatacaacctaaaacagatatctctatcacaacaatcaatgaaatacatcctagactacattgacgacccaaacttcaataaacacgaaatgacaaaaatagaccaacaaaacgagaaagaatgccttctctccgtttacgatgagatactcgacaaaatggacaaatatctatcactatacgacataaatggctttcgcaagaaacttcacgtggggagagacaaattcataaaactagaagttgagaaacaagccgaagcaatcaaaaacgtcctgcgggggttccacgccaactccgacatgaccaaactatccgacctcggcctatccaccagcctcggcttcatgcaagccagcgacggcattaaactatccgacaatgccgtattcatataccaatcacccaccggactattcgaacgaagagtcaaagtatccgacctcttaaaatga

SEQ ID NO: 6798 - RNA, 4260 nt, synthetic construct
  misc_feature 1..4260: note = Cas9 variant
  source 1..4260: mol_type = other RNA
atgatgatcaaaaatatcctgggactcgacctgggaactaactccataggatgggctctaatcaaacaaaacttcgagaacaagtacggcgaaattctgggcatgggatcccgcataattccaatgagccaagacgtgctcggggagttcggaaagggcaattcagtaagccaaaccgcggcacgaaccggctacagaggagtccgccgactacgcgaacgcttcctactccggagagaacgcctgcaccgggtcctgaacgtactcaacttcttacccgagcactacgcctcccaaattgactttgagaaacgcttcgggaaattcaagtacgaaaccgaaccaaaactcgcctataacaacgatggattcttcttcaagaacagcttcgatgaaatgcttggtgacttcaaagaccaccaattccacctactagagaacgggcggaaagtaccatacgactggaccatctactaccttcgaaagaaggccctaagccagaagatagaaaaagaagaactagcatggatcttgctaaacttcaaccagaaacggggatactaccaattacgaggagaggacttcgaggaggagaaagaccgcgtcttcgtcagactaaaagtagaccgcgtggtcgacagcggcgagaacataaaaggcaaaatactctacgacgtttacttcgagaacggctggaaatacgaaaaacagatcgtgaagacggaagactggatcggccgaaccaaagagttcatcgtaacagaatccatcctaaagaacggcgacacaaagaggacctttaaagccgttgacagcgaaaaggactggatcgccattaagacaaaaaccgaacaagagatagacaagtcacacaaaactgtcggagcatacatatatgaggcactcctgcaaaatcccaaacagaagatcaaaggcaaactcgttagaacgatcgagcggaagttctacagagaagaactaaagaaaatcctggaaaggcagaaagaatttcacccagaattacaaagtgatgacctatacaacgactgcatcagggaactgtaccgcaacaacgaagcgcaccagattaccctctccaagaaggacttcgtccaccttctcctgaatgacctcatcttctaccaaagaccactgcgctcccagaaaagttccgtctccaactgtacactcgagttcagaaagtacaaagacgaaaacggcgtcgaacacgcacaatacctaaaaacaatacccaagagcaatccatactaccaggagttccgggtgtggcaatggatgttcaacctcaacatataccggaaggatgacgacacgaacgtaaccaaagagtttctatcctccactgaagactatgagacgcttttcgagttcctaaacaaccgcaaggaagtcgaccagaaagcactccttcgccacttcaaactcaatgagaaaacgcatcgatggaactacgtggaagacaagaaatacccatgcaacgaaacaaaaacgatgatctccacccgcctggagaaagtcgaaaactatccctcagacttcctcacccgcgaaatggaacagaacatctggcacatcatatactccgtcaacgataagatcgaatacgagaaggcactcaaatcattcgcccacaaaaacaacctcgacgaaaacagcttcttcgaagcgttcaaaaagttccctcccttcaaaagcgaatacggcagcttctccgaaaaggcgatcaagaaactactcccgctccttcgactaggcaagtactggaattgggagtccatagaccgaaagtcccaagggcgcatcgagaagatcattacaggcgaatttgacggaaatataaaggacaaagtccgagagaaggcaatacacctcaccgccgaaaacgacttccagggattacaactatggctggctcagtacatcgtctacggccgtcactccgaggcttccatgatcggaaagtggaactccgccgacgacctagaggagttcctcaaaggtttcaaacagcactcactgcgtaaccccatcgtagagcaagtcatcacggagacactccgggtagtaaaggacatatggcttaagtacggcaacggagcaaaagacttcttctccgagattcatatcgagctcgggagagagatgaaacaaacgaaagatgagagagtcgacgccaccaagcggatcacagaaaacgagaacacgaacctccggatcaaagcattgctcgccgaaatgatgaatgataacagtgtcgaaaacatccgaccttactcccccatgcaacaagagatactgaaaatctacgaagatggtatattaaaatcagacatagaaatcgacgatgacatcctaaagataagcaagactgcacaacccagcagctccgacttaaaaagatataaactatggctcgagcagaggtacaaatcaccatacacgggccaaatcatccccctcaacaaactcttcacgtcagaatacgaaatagagcacataatcccccagtcgcgatatttcgacgacagcttctcaaacaagatcatctgcgagtcagccgtcaacaaactaaaagacaactacatcggacttgggttcatcaaacagttcggcggtatgatcgttgaatgtggcttcggcaagtccgtcgagatattcaaggctgaggaatacgaggattttgtaaagaagcactatgctaacaaccgcagcaaacgaaacaagctgctactcgaggagataccggagaaaatgatagaccgccaactcaatgacacacggcacatcagcaaatacatatcaggggtactttccaacatcgtacgccaagaagacggaaccgacgaaggggtaaactctaagaacatcgtaccgggaaacggaaaaattacaacacaactcaaacaggactggggactcaatgacgtatggaacgaactgatcctccccagattcgagcggatgaaccagctaacgaactcgacggacttcaccagctggaataaaaaccaccagaaattcctcccaaccgtacccatcgagttctcgaagggtttctcgaagaagagaatagaccatcgccatcacgcaatggatgcgctagtgatcgcatgcgcaacaaaggaccacatcaacctcttaaacaaccaaagtgccaaaagcgacacgaaacggtacgacctcaagcgcaaacttatgaaattcgaacgggtcgtttacagccactcaaagacgggggagaaaatagagaaggaggtccccaaacagttcctaaagccctgggacaacttcacagtcgacgcaaagaacaagatggaaactatcatagtctcttttaagcagaacctccgggtgatcaacaaggccaccaaccactacgaaaaatggatcgaaaaggacggaatcaagcgcaaagaactcatcaaacaagaagggaccaactgggcaattagaaagcccatgcacaaggaaaccgtctccggcaaagttgaccttccaggcatcaaaatccccaaaggaaaaatactcacggcgacccgcaaatctctcgacacatcctttgacctcaaaaccataaactcaatcaccgacacaggcatccagaaaatcctaaagaactacctcgagttcaaaggaagctcagaactagcgttctccccagaaggcatagaagacatgaacaaaaacattgaaaagttcaacgacggaaaaccgcaccaatcaatcaacaaagtgcggatcttcgaactcggatccaaattctcagtgggacaaactggcaacaaaaaggacaaatacgtcgaagcagccaagggaaccaacctgtttttcgcggtatacgaagacaaaaacggcaaacgatcctacgaaaccatcccactcaacgaagtgatcgaacggcaaaaacaggggctcgacagcgtgagcttcaaaaacaaagaagacttcctcctctgcccgaacgacctggtttacgtaccatcagaggacgaactggagaatatctacaacatagacttcaaaaacctcacgaccgagaaaaccggcaacatctacaaagtcgtttctttctcagggaatcagatattcttcatcaggcaagacatcgcaatttcaatcgtcaacaaagccgaatttagcactttaaacaagatggagcgcgcgatcgacggctccatgattaaagaaaattgcataaaactaaagatagaccgactaggcaacatcgccaaaatctga

SEQ ID NO: 6799 - RNA, 4263 nt, synthetic construct
  misc_feature 1..4263: note = Cas9 variant
  source 1..4263: mol_type = other RNA
atggctaagccaaaggattacaccataggattagacattggcaccaacagcgtcggatgggtagtaaccgacgaccagaacaacatactacgcatcaaaggtaagaaagccatcggagcacgcctatttaccgaaggaaaagtagcagcggaaagacgtagcttccgaacgacccgacgcagactatcgcgacgtagatggcgcatcaagatgctcgaagaactcttcgacgaagagatagcaaaagtcgatcccagcttcttcgccagactccacgagagctggatctcacccaaggataaacgcaagcgctattcggccatcgtcttccctagtccagaagaagacaaaaagttccacgagtcgtacccgacaatctatcatctgcgagataaacttatgaaggacgaccagaaacacgacatcagagaaatctacattgccgtacaccaaatgatcaaagcccggggcaacttcctgcacgacgagagcgtagaaacataccgctccggaatgtcctcactgggcggccgatcagaacgcacaatactaagcgtgcaaacgctcgaagaactcaacgacctattcgccgaaaacgaagggacagaagaagtggaactcaacgtcgccagcgcggaacagattaacgacatccttacaggaggccacctcaacgccgactcgcagaaagaaatctccaacctcctcctcccgagttccttcccatccttcgacgacaaagcgaaagaaaaacaagtcaagaaactcatcaacaatgtcgcaacaaacatcagcaaagcctggctaggctataaagcggacttctcaacgatactcaatctggccaaggtcgacaaagatcaaaagaaaatctttgcattcgccctacagggcgaagacgaggaagacaaagtccaagaactggaaagcctcctcgaacaaagtcagacagacatagtagaccgcctaatcgaaatcagacacgccatcgtcctgagcgaaatcgtcccagtcggaatgaccctatccgaagccatgattgacaaatatgaccaacacaaagaagacctgatcacattaaaagccgtgatacgaaatacaaaagacaagaaaaaggccgctaagctccaagccatctacgacctctacgtcaaaaacagacacgccgacctcgcaaaagcgatgaaactcacaggcataaagaaacgttccgaacttctggacccagaggaactcaagaaaggcatctcgagcctgctcgacgactctcctgaagcggtagaaatcaaacaacgcttagaagagaagacattcctcccccttcagcgctcaaacaataacggcgtcataccgaaccaactacaccaagtagagctagacgagatcataaagaaacaaagcaaatattaccccttcctggcggagaaaaaccccgacgaatcagaagaagcccagaaaaaggcccctactaaactagacgcgctcctgactttcagagtcccatactacgtaggaccaatgatcaccaaggaagaacaggaggcacagaacggccactccttcgcgtggatggtccgacgggacccacaagatcacgaagcgataacaccctggaacttcgaaaagaaagtcgacaaaatggccagcgcgacgcagttcatcaaaagaatgaccaccaaagacacataccttctgggtgaggacgtcctaccagcctcaagcctcaagtaccagctatttacggtactgaacgaacttaataacctccgagtaaacgggaagaaattgacgagcgatgaaaaagaacaagtcatagagggcctctttaagaagcaaaagactgtcaaggcggacaaattcgtaaaatactggcaagccaaacacatcggagctgatatcaaagttaaaggcctgtcagacccttctaaattcaattctaccatgagtacctacatcgatttcaagaaaatattcggcgaccaattaaatgacgtcaatagacagaacgacttcgaaaagatcatcgaatactcaaccatcttcgaagaccgcaagatacttgaggacaaactgcgcgcagatttcgcctggttatccgaagaacaaatcaagcagctatgtcgccttaggcttcagggatggggtcgcctgagcgacaagctactgacccgcttgacagacgccgacggacaaaacgtcctagaacgactgtggaatagcaacgacaacttcgtacaaatagtcagcgaccctaatatcaaagccaaaatcgagcaagagaaccagaaactcctccgagactcccaatccgacaatgcggtagaaagcatcctggacgacgcctatacaagcccacaaaacaaaaaggcaatccgccaggtcatgagggtagtccacgacattgtcaaggcatgcgacggcaacgtccccgccaaattcgcaatcgagttcgcgaggagccaagaagacgacccaaaaaggacgacggcaagagtcaaccaaatgcagaaaatctacgaccaaatctctgacgaggtagtatcacaaggcgtaaaggagcaactgtcaggtatgaagtcactaaaagatagatactatctttacttcatgcaagggggccgcgacgcgtacacaggtgccaagctgaatatcgaccggctatcggactacgacgtcgaccacataatgccccaaagttttgtgaaagacgactcactagacaatagagtcctagtcgcccgagcagtcaacaaccaaaaatccgacaaagtcccagccctcctgtttggaaataaagtcgtcgccgatctagggatcaccgtccgggagatgtgggacaaatggcagaaactggggatgatatcaaaacgcaaactctccaacctcttaaccgatcccgacgcattgacagagtaccgcgcacaaggattcatccgacgccagctagtcgaaacgtcacaagtgatcaagctcacagcaacaattctccaaagcgagttccctgacagcaaaattatcgaagtacccgccaaatacaacagcatcgtccgaaagcaattcgacctctacaagtcccgagaggtcaacgacttccaccacgcgatagacgcctacttgagcaccatcgtggggaactacctctaccaggtctaccccaatctccgcagaatgttcgtatacggggagttcaagaaattctccagtaacgccgaagaaagcgcccacgacgtagctcgccgcgttaaatcaatgaacttccttgacgatctgctccgaggcacacacggcgacaacatctactgccgctcaaccggggaaatcgtcttcaaccgcaacgacatcatcagcaaactaaagcaagcctatagcttcaaacaaatgctcgtcacgcaagaagtcttcacgcgcaagagcgccctctttgaccaaacagtctacccctcccctgaacgagattcaaagaaacgcagcgggctaataccccggaagaaaggcatggaccccgaaatctatggcggctatgcacacaaccaagacagctactttgtactcgctaaaatcgagaaagtcaaaggctacacacttcaaatagtcggcgtgcccatcagatcactggaaataatcaacaaagccgaggatttcagcacagccttactagacattatcaaaagcaaagtcatgtacaacgagaaaaccggccaaccgaaacgcggaataaagaacgtagagatccttgtgaacaaactcccatacagacaacccattttagagaaagacgtaagctacatgctcggctctagcgcgtataagtacaacatgaaacaaataaccctgagccgccagagcatgaaatacatactcgactacatagacgaccccaatttcactaaacacgaaatgaccatgatagacgagcaaaacgaacgcgaatgcctgctcagcgtgtacgacgagatactcgaaaaagtggacaaatacctacccctatttgatggcaacaaattccgtgaaaaactgcatagcgcgcgaaaggagttcgtcagcctcagcgtcgacgacgaagcatcggcaattgagaagatccttcgaggactccacgcgaacagtgaaatgccatcactcgagaatctgaaaatcaaacccgccctgggattcttccagatgaagaacggaataacacttagtaacgacgcagtgctgttataccaatcgccgacgggcctattcgaacgccgcgtcaaagtatccgacctcctaaagtga

SEQ ID NO: 6800 - RNA, 4263 nt, synthetic construct
  misc_feature 1..4263: note = Cas9 variant
  source 1..4263: mol_type = other RNA
atggccaagccaaaagactatactatcggactcgacataggaaccaactcggtcggatgggtggtaaccgacgaccaaaacaacatacttagaatcaaggggaagaaagccatcggagcgcggctatttaccgagggtaaagtcgcagcaaaacgacgttcattccgcacgaccagacgccgcctgtcacgaagacgctggcgaataaaactcctagaggaactctttgacgaagaaatagccaaagtcgacccatctttcttcgcacgcctccacgaatcatggatctctccaaaagacaagagaaagcgatactccgccatagtattcccctcacccgaagaggacaagaaattccacgagtcatacccaactatataccacctacgggacaaactaatgaaagatgaccagaaacacgacatacgggaaatatacatcgccgtgcaccaaatgatcaaagcacggggaaacttcctacacgacgagtccgtagaaacttaccgctctgggatgtcaagcctcggtgggcgcagcgaaagaacaatactctccgtgcaaaccctggaagaactcaacgacttgttcgcagaaaacgagggcacagaggaagtcgagcttaacgtagcgagtgctgaacaaatcaacgacatattaaccggcggccacttaaacgccgacagccagaaagaaatttccaacctcctgctcccaagttccttcccatcctttgacgataaagccaaggagaagcaggtcaagaaactcatcaacaacgttgcgaccaacatttcgaaagcctggctgggttacaaagctgacttcagcacaattctgaacctcgcaaaagtcgacaaagaccagaagaaaatatttgccttcgccctgcagggggaagacgaggaagacaaagtgcaggagctcgagagcctactagaacaatctcagaccgacatagtagaccgcctaattgaaatccgccatgcaattgtactctcggaaatcgtccccgtaggcatgacactgagcgaagcaatgatagataaatacgatcaacacaaagaggacttgataacactcaaagccgtgatccgcaacaccaaagacaagaagaaagccgcgaaactacaggccatttacgacctatacgtcaagaacaggcacgccgacctcgccaaggcgatgaaactcaccggaatcaaaaagagaagcgaacttctcgacccggaggaactaaagaagggaatctcgagcctgctggacgactcaccagaagccgtagagataaaacaacgcatagaagagaaaactttcctccccctgcaaaggagcaacaacaacggagtcatcccgaaccagctacaccaagtagaactcgacgagatcataaagaagcaatccaaatactacccattcctcgcggaaaagaaccctgacgagagcgaggaagcgcagaaaaaggcccccaccaaattagacgcacttctcacattcagagtaccctactacgtcggcccaatgatcacgaaagaagaacaagaagcgcagaacggccactcctttgcctggatggtccgacgagacccacaagatcatgaagcaataaccccttggaacttcgaaaagaaagtcgacaagatggcctcagccacgcaattcatcaaacgtatgaccacgaaagacacatacctgctcggcgaagacgttctcccagccagttcactgaaataccaactcttcacagtgctcaacgaactcaataacctacgagtcaacggtaagaaattaacctcagacgaaaaagaacaagtgatcgaggggctctttaagaaacagaaaacggtaaaagcggacaaattcgtcaaatactggcaagccaaacacataggagcggatatcaaagttaaaggcctcagcgacccatctaaattcaacagcaccatgtcaacctacatcgacttcaaaaagatattcggcgatcaactcaacgacgtcaaccgccaaaatgactttgagaaaatcatagaatactccaccatatttgaagaccgaaaaattttagaagacaaactgcgagtagacttcgcttggctgtcggaggagcaaataaagcaactatgccgcctacgcctgcaaggatgggggcgtctgtccgacaaactgctcacacgactaacagacgccgatggacaaaacgtactggagcggctgtggaatagcaacgacaacttcgttcagatagtcagcgacccaaatatcaaagcaaagatagagcaagaaaaccaaaagctactgagagacagccaatccgacaacgcggtggaatctatactcgatgatgcatacaccagcccgcagaacaagaaagcaatccgtcaagtgatgcgagtggtgcacgacatcgtcaaggcctgcgatgggaatgtacccgccaaattcgcaatcgagttcgcacgaagtcaggaggacgaccctaaacggacgaccgcacgcgtaaaccaaatgcaaaagatatacgaccaaataagcgacgaggtagtctcccaaggagtaaaagaacaactatccggcatgaagtcgttgaaagatcggtactacctctacttcatgcaagggggccgcgacgcatataccggcgccaagttaaacatcgaccgcctctccgactacgacgtcgaccacatcatgcctcagagcttcgtcaaagacgacagcctcgacaacagagtcctagtcgcacgcgcggtcaacaaccagaaaagcgacaaggtccctgccctactattcgggaacaaggtagtagcggacctgggcatcaccgtcagggagatgtgggataaatggcaaaaactaggcatgataagcaaacgaaagctaagtaacctacttaccgacccagacgctctgaccgagtatcgtgctcaaggcttcatcaggcgccaactcgtcgaaaccagccaagtgatcaagctcaccgccacgatactccaatctgagttccccgacagcaagatcatagaagttccggctaaatacaacagcatagtaagaaaacaattcgacctatacaaatcccgggaagtcaacgacttccaccacgccatcgacgcataccttagcaccatcgtcggaaactacctctatcaggtatacccgaacctgcgccggatgttcgtatacggcgagttcaagaagttctcaagcaacgccgaggaatccgcgcacgacgtcgcccgccgagtcaaatcaatgaacttcctcgacgaccttctcagaggcacacacggggataacatctactgccgtagcaccggggaaatcgtgtttaaccgaaacgatatcatttcgaaattgaagcaagcgtacagcttcaagcaaatgctcgtaacccaagaggtcttcactaaaaagagcgccctattcaaccaaacagtctatccaagtcccaaacgcgacgggtccaaacgatcaggccttataccccgcaaacgaggcatggaccctgagatctacggaggatacgcacacaaccaagactctcacttcgttctcgccaagatagaaaaagtgaaagggtacacgctacagatagtcggagtaccaatcagatcattagaaatcatcaacaaagctgaagatttctcgaccgccctattagacatcatcaagtcgaaggtcatgtacaacgaaaagacgggccaaccaaagagaggcatcaagaacgtggaaatcctcgtcaataaactgccatacaggcagcccatactagaaaaggatgtatcctacatgctcgggtcatccgcatacaagtacaacatcaaacaaataaccttaagtcgacaatccatgaaatacatacttgattacatagacgaccccaacttcacgaaacacgagatgaccatgatcgacgagcaaaacgagcgcgaatgcctactctcggtctacgacgaaatcctcgagaaagtagacaaatacctccccctgtttgacggaaacaaattccgcgaaaaactacactcagcacgaaaagagtttgtctcgctgtcagtcgacgacgaggcgtctgccatagaaaagatactcagaggactccacgctaactccgagatgccctccctggaaaacctcaaaatcaagccagcactcggcttcttccaaatgaaaaacggcattacactcagcaacgacgcagtcctgctgtaccaatcacccacagggctatttgaaagacgagtcaaagtgtccgacttgctaaagtga

SEQ ID NO: 6801 - RNA, 4263 nt, synthetic construct
  misc_feature 1..4263: note = Cas9 variant
  source 1..4263: mol_type = other RNA
atggccaagttcaacaaaaactactcgatcgggctggatatcggcgtctcctcggtcgggtacgctgtcgtgaccgatgactaccgcgtacccgcgttcaaattcaaagtacttgggaacaccgaaaaagagaaaatcaaaaagaaccttatcggcagcaccacgttcgtccccgcgcagtccgcgcagggcacacgagtttttcgcgtgaaccggcgccgcatcgaccgccgcaaccaccggatagcctacttacgcgacatttttcagaaagaaatcgaaaaagtcgataaaaacttctatcggagattagacgaatccttccgtgtacttggcgacaagtccgaagaattacagatcaaacaacccttcttcggcgacaaagaactggaaacggcctaccacaaaaagtatcctaccatataccatctccgcaagcacctcgcagatgccgacaaaaactcaccggttgcagacatcagggaagtatacatggcaatctcacacatcctaaaatatagggggcacttcctaacccttgaccgcatcaaccccaacaacatcaacatgcagaacagctggatcgacttcatcgaatcctgccaagaggttttcgacttggaaatctcggacgaatcaaaaaccatcgtagctatcttcaagtccagcgacaaccgccaggaaaaagtgaagaaaatcctctcctactttcagcaggaactcctaaagaaggacaagtcaatctttaaacaactccttcaactactgtttggcctaaaaactaagttcaaagactgttttgaactcgaagaagaacccgatttaaacttcagcaaagaaaactacgacgaaaatttagagaacttcctaggatccctagaagaggatttctctgatgtctttgcgaagctcaaggtgctccgggacacgatcctgctatccgggatgttaacctacacaggcaccactcgcgcccgcttctccgcaacaatggttgaaagatatgaggagcaccgcaaagacctccagcgattcaaatcctttgttaaacaaaacctcagcgaacaagactaccttgacatcttcggccgcaaaaccccaaatggattcgacgtcgacaaagagaccaaaggctacgttgggtacatttcgaacaaaatggtactcacaaacccgcaaaaacagaaaaccatacagcaaaacttctacgattatatatctggcaaaattacaggcatcgaaggagccgagtacttcctcaacaaaatttcagacggcaccttcctcaggaaattacgaacgacagacaatggcgctgtacccaaccaaatccacgcctacgaattagagaaaatcatcgaccgccaaggggaagactacccgttccttcttgaaaacaaagacaagctcctcagcatcctgaccttcaagatcccatattacgtcggtcccctctcaaaagggaacaactcacgcttcggatggattaaaagaaccatcagccaagacatcttagacgacaatgacgaagacacacgcaacggaaagataaggccctggaattaccagaagctcattaacatggacgaaacccgagacgcatttataacaaaccttataggcaatgacatcatccttctcaatgaaaaggtcctcccaaagagaagtctaatatacgaagaagttatgcttcaaaacgaacttacccgcgtaaaatacaaagacaaatacggcaagacacacttcttcgactccgagctccgacaagaaataatcaacaacctcttcaaaacaaacaacaagcgagtctcatccgcgatgctgctcgactatctcgagaactacacaaatttgcaggccgtcgaaatcgtatccgggattgaaaaaggcaagtccctgaacagcaccctcaaaacatataacgacttgaaaactatcttcagcgaggaactgctagactctgaaatctaccagaaggaactcgaggaaatagtaaaagtcatcaccgtattcgacgataagaaatccattaaaaactaccttataaaatatttcggccacctggagttcttaaacgaggaacgcataaaccaattatctaaactacgctacaccggatgggggcgatactccgcaaaactcttactagatatccgcgacgaagacacaggcttcaacctaatgcaattcctccggaacgacgacgagaatagaaacctaagccagctcatctccgactcaaccctatccttcgattcggcaatcaagtctatccagagcaagtccacagtcgaagacgacgtcttcgacgaaatcaagaagctcgccggcagccccgcaataaagcgtggcatcctcaactctataaagatcgtggacgaactcgtccaaatcatcggatatccacctcagaacatagtcatcgagatggcccgagaaaatatgaccacggaagaaggccaaaagaaagccaaaacccgcaaaaccaaactagagtcagccctcaaaaacatagaaaattcagtattggaaaatggaaaagtcccccactctgacgaacaattacaaagcgaaaaactttacctctactacctacaaaacgggaaggacatgtactcactagacaagacaggctcccccacacccctataccgggaccaactcgaccaatatgaagtcgatcacatcataccttactcgttcttgccgatcgactccatcgacaacaaagtcctaacacaccgcgaaaacaaccagcgcaaactaaacaacatcccagacaaagaaaccgtagccaacatgaaacccttctgggagaaactatacaatgccaaattgataagccaaaccaagtaccaacgactcacaacctcggaaaggacgcccgacggtgtcctcacagagtccatgaaagcaggcttcatcgaacggcaactcgtcgaaacccgccaaatcataaaacacgtcgcacgaatcctagacaaccgcttcctcgacacaaaaataatcgcacttaagagccaactaataaccaactttcgaaacacattccatatagcaaaaatacgcgaactaaacgactaccaccacgctcatgatgcttacctcgcagtcgtcgtaggtcaaacccttctaaaagcatacccgaaactcgcgcctgaactcatatacggccaccacgcccatttcaaccgccacgaagagaacaaggcgaccatacgaaagcatctctactcaaacatcatgcgattcttcaacaacccagactcaaaagtctcaaaagacatctgggactgcaaccgcgaccttccaataatcaaagaagtcatctacaatagccaagtcaacttcgtcaaaagaactatgataaagaaaggagcattctataaccaaaatcccgtcggcaagttcaacaagcagatcgcggcaaacaaccgatacccactgaagacaaaagtctcctcgctcgacactagcatctacggaggctatggcccaatgaacagcgccctatcgatcatcattatcgccgaacgcttcaacgaaaagaaaggaaaaatcgagaccgtcaaggagtttcatgacatattcataatagactacaagaaattcaacaacaacccgttccaatttctaaacgacacatctgaaaacggcttcctcaaaaagaacaacatcaaccgcgttctagccttctacggcgttcctaaatacagcttaatgcagaaaaacgacgggacacgcatgctattcgaaagcaagtcgaacctgcataaagctacgcaattcaaactcactaaaacgcaaaacgaactctttttccatatgcgccgcctgcttaccaagagcaacctaatggacctcaaaagtgagtcagccattaaggagagccaaaacttcatactgaaacataaagaggagtttgacaacatctccaaccagctctcggcattctctcaaaagatgctaggcgacacaacgtccctacgcaacctaatcaaggggtacaatgaaagaaaaatcaaggaaatcgacagctccgaggaggtcataaaatacttctacgacaacttcataaaaatgttctcattcgtcaaatccggagcaccgaagggcatcaacgactttttcaacaataaatacaccgtagcacgcatgcgcccaaaaccagataagaaatttctcaacgcaacgcttatacaccaatcgatcaccggactctatgaaacccgcatagatctctcaaaactgggagaagactga

SEQ ID NO: 6802 - RNA, 4263 nt, synthetic construct
  misc_feature 1..4263: note = Cas9 variant
  source 1..4263: mol_type = other RNA
atggcgaagtttaacaaaaattactccattggacttgacatcggcgtaagctccgttggatacgcagtggtcacagacgactaccgcgtccccgcatttaaattcaaggtcctcggtaacaccgaaaaagaaaagataaagaaaaaccttatcggctcgacgacattcgtcccagcgcaatccgcccaggggacccgggtcttcagagtgaaccggcgccggatagaccgtcggaaccaccggatcgcgtaccttcgcgacatattccagaaagaaatcgaaaaagtcgacaaaaacttttaccgccgtctagacgaatcctttcgcgtcctgggagataaaagcgaggagctgcaaatcaaacagcccttcttcggagacaaagagctcgaaacagcctaccacaagaaataccccacgatttaccacctccgcaaacacctagccgacgcagacaaaaactcacctgtagctgacatacgagaagtctacatggccatcagccatatactaaaataccgcggtcactttttaaccctcgaccgcataaatcccaacaacataaatatgcaaaactcctggatcgatttcatagagtcatgccaagaggtattcgacctagagatatctgatgaatcgaaaacaatcgtcgcaatattcaaatccagcgacaaccgccaagaaaaagtcaagaaaatacttagttacttccaacaagaactcctcaagaaagacaaaagcattttcaaacaactactccagttactcttcggcctcaaaacaaaattcaaagactgtttcgaactcgaagaggaacccgaccttaacttctccaaagagaactacgacgaaaacttggaaaactttttgggctcactcgaagaagatttcagcgacgtgttcgccaagctaaaagttctacgcgatacgatcctcctcagcggaatgctcacatacacgggcaccacccgcgcccgtttctctgccaccatggtcgaaagatacgaagaacaccgaaaagacctccaacgtttcaagagctttgtcaaacaaaacctatcagagcaggattacctcgacatattcggtcgcaagacaccaaacggattcgacgtcgacaaagaaacgaaaggctacgtcggctacatctcgaacaagatggtactaacgaacccgcaaaaacagaaaacgatccaacaaaacttctacgactatatctccggcaaaattaccggcatcgaaggtgcagaatacttcctcaacaagataagcgacggcacttttctccgaaaactacgcacgaccgacaatggagcagtccctaaccagatacacgcttacgaactagagaaaatcatagaccgacaaggcgaggactaccccttcttactcgagaataaagataagctactctccatactcaccttcaaaatcccatactacgttggacctctatccaaaggcaacaactcaagattcggctggataaaacgcacgataagtcaggacatcctcgatgacaacgacgaagatacccgcaacggaaagattcgcccttggaactaccagaagctcataaacatggacgaaacaagggacgcctttataacgaacctcatcggcaacgacataatcttgctaaacgagaaggtccttcccaaaagatcactgatctacgaggaagtcatgctccaaaacgaactaacccgggtcaaatacaaggacaagtacggcaagacccactttttcgactccgaacttcgccaggaaatcatcaataatctcttcaagacaaacaataaacgagtctcctccgccatgcttctcgactaccttgaaaactacacaaatctccaggcagtcgaaatagtcagcggcatagagaaaggtaaatcgctcaacagcacactcaagacctacaacgacctgaagaccatattctccgaggaactgctggactcagaaatataccagaaagaactcgaagagatcgtaaaagtcatcaccgtattcgacgacaagaaaagcatcaaaaactacctgatcaaatacttcgggcatctcgaatttctaaacgaggaacgcatcaaccaattatcgaaacttcgatacaccggctggggccgctattccgctaaactacttctcgacatccgcgacgaagacacaggattcaacttaatgcagttcctccgaaacgatgacgagaaccgtaacctgtcgcagcttatctccgactctacactcagcttcgattcagccatcaaaaccatccaatcgaaatccacggtcgaagatgatgtattcgacgaaataaagaaactagcaggctctccggccataaaacgaggcatcctgaatagtattaaaatagtagacgagctagtccaaataattggctacccaccccaaaacattgtcatcgaaatggcgcgcgaaaatatgaccactgaggagggacagaagaaggccaaaacgaggaaaacaaaactcgaatccgccctcaagaacatcgaaaattcagtattagagaacggcaaagtaccccacagcgacgagcaattacaatcagagaaactctacctttactacctgcaaaacggcaaagacatgtactccctagacaagacaggctccccaactccgctataccgggaccaactggaccaatacgaggtagaccacatcataccctactcctttctcccaatcgatagcatcgataacaaagttctgacacaccgggaaaacaaccaacgcaagctaaacaacatccccgacaaagagaccgtcgccaacatgaaaccattctgggagaaactatacaacgccaaacttatctcccaaaccaagtaccaacgcctcaccacctcagaacgtaccccagacggagtcctcaccgagtccatgaaagccggattcatcgaacgacaactggtggaaacgcgccagatcatcaaacatgtagcccgcatcctcgacaatcgtttcctcgacacgaaaatcatcgcgctcaagtcccaactcatcacaaactttcgaaacacctttcacatcgccaaaattcgcgaactcaatgactaccaccacgcacatgacgcatacctggccgtcgtcgtcggtcaaaccctgctaaaggcttaccccaagctagctcccgagttgatctacgggcatcacgcccacttcaaccgccacgaagagaacaaagcgacaatacggaaacacctatatagcaacatcatgcgcttcttcaacaacccggactcaaaggtatcaaaagacatctgggattgtaaccgagacctcccaataataaaagaggtcatctacaactcccaagttaacttcgtcaagcgaaccatgatcaagaaaggcgctttctacaatcaaaaccccgtaggcaaattcaacaaacaaatagccgcaaacaaccgctatccacttaaaacgaaggtgagctccctagacacctcaatctacggcggttacggacctatgaactcagccctctcgatcatcatcatagccgaacgcttcaatgaaaagaaaggaaaaatcgaaacagtcaaagagttccatgacattttcataatcgattacaaaaagttcaacaacaatccattccaattcctcaacgacaccagcgaaaacggctttctgaagaaaaataacatcaaccgagtactggcattctacggagtcccgaaatacagccttatgcagaaaaacgacggcacccggatgctgttcgaaagcaaaagcaacctacacaaagccacccaattcaaactcacaaaaacacaaaatgaactattcttccacatgcgtcgcctacttaccaaatccaacctgatggacctcaaatcagagtccgccattaaggaatcccaaaactttatcctgaagcacaaggaggaatttgacaacatatcaaaccaactgtccgccttctcgcagaaaatgctgggcgacactaccagcctccgcaacttaattaaaggatacaatgaacgcaaaatcaaagagatcgattcatcagaagaagtcattaagtacttctacgataatttcataaagatgttcagctttgtaaagagcggagccccaaaggatattaatgacttctttaacaacaaatacacagtcgcacgaatgcgccccaagcccgacaaaaagtttctaaacgccaccctgatacaccaatcaataaccggcctgtacgagacgcggattgatctgtcaaaactcggtgaagactga

SEQ ID NO: 6803 - RNA, 4263 nt, synthetic construct
  misc_feature 1..4263: note = Cas9 variant
  source 1..4263: mol_type = other RNA
atggccaagttcaacaagaactactccatcggccttgacatcggcgtgtcatcagtcggctacgcagtggtaactgacgactaccgcgtgccagcattcaagttcaaagtccttggcaacaccgaaaaagagaaaatcaagaaaaacctcatcggctccaccacattcgtgcccgcccaaagcgcacaaggcacgcgcgtattcagggtcaacagacgcaggatagaccgccgcaaccacagaatagcatacctccgtgatatcttccaaaaagaaatcgagaaggtagacaagaacttctaccggcgcctcgatgaatccttccgcgtcctaggggacaagagcgaagaactccaaataaaacaacccttcttcggcgataaagaacttgaaactgcgtaccacaagaaataccctaccatctatcatctaagaaaacatctagctgacgcggacaaaaactcacccgtcgccgacatccgtgaggtctacatggcaatttcccacatcctaaaataccgaggccacttccttacccttgaccggatcaatccaaacaacataaacatgcagaacagttggattgacttcatagagtcctgtcaagaggttttcgatctggagatttcagacgaatcgaaaacaatagtcgccatctttaaatcatccgacaacaggcaagaaaaagttaagaaaattctctcctacttccagcaggagctactcaaaaaggacaaatccatcttcaaacagttgcttcagctcctattcggcctcaagaccaaattcaaggactgcttcgagctggaagaggagccagacctcaacttcagcaaggagaactacgacgaaaacctggaaaacttcttgggctccctcgaggaagacttctccgacgtattcgcaaaactcaaggtactccgggacacaattcttttgtccgggatgctcacatacaccggaacaaccagggcacgtttctcggcaaccatggtcgaacgctacgaggagcaccgaaaggacctccagcggttcaaatcgttcgtaaaacaaaacctttctgaacaggactacttagacatatttggccgcaaaaccccgaacggcttcgacgtagacaaagaaacgaaagggtacgtcggttatatcagcaacaagatggtcctaactaacccacagaagcagaaaaccatccaacagaacttctacgactatatctcagggaagatcaccggaatagaaggcgcagagtactttctcaacaaaatatccgacgggaccttcctgcgaaaactacgcaccaccgacaacggggccgtacccaaccaaatccatgcatacgaactagagaaaatcatcgacaggcagggggaagactaccccttcctcctggaaaacaaagataaactactcagcatactcaccttcaagatcccatactacgtaggaccactcagcaaaggaaacaattcgcgcttcggatggatcaagcgcacaatcagccaagacatcctggacgataacgatgaagacacccgcaacggaaaaatccgcccctggaactatcagaagctcatcaatatggacgaaacccgcgacgcgttcatcaccaacctcatcgggaacgacataatccttctcaacgaaaaagtcttacctaaacgcagtctaatatatgaagaagtcatgctccagaacgaattgacccgcgtaaaatacaaggacaagtacgggaaaacccacttcttcgatagtgaactacgacaggagataataaacaacctcttcaaaactaacaacaaacgcgtgtcgtcggcaatgctactagactacctagaaaactacactaacctccaagccgttgaaatcgtcagcggcatagaaaaaggcaaatcgctgaacagcacgctgaagacatataacgacctgaagacgatctttagcgaggaactgttagacagcgaaatctaccagaaagaactggaggaaatcgttaaggtcatcacggtatttgatgacaagaaatcaattaaaaactatctaatcaaatactttgggcacctagaatttctcaacgaggaacgaatcaaccaacttagcaaactgcgctataccgggtggggccgctacagtgcaaaactactcttagacatccgcgacgaggacacaggtttcaatctaatgcagttcctgagaaacgatgatgaaaacagaaacctatcgcaactgatctccgactcaacgttatccttcgactccgcaatcaaatcgatccaaagcaagagcacagtggaggacgacgtattcgacgaaatcaaaaagctcgccggcagccccgccattaaacgcggcatcctaaattcgataaaaatcgtcgacgaactcgttcagataatcgggtaccctccccaaaacatcgtaatagaaatggcacgcgaaaacatgaccactgaagaaggccaaaagaaagccaaaacgcgcaaaaccaaactcgagtccgccctcaaaaacatagagaacagtgtactcgaaaacggcaaagtcccccacagcgacgaacaactacaaagcgaaaaactgtacctgtactacctacaaaacggcaaagacatgtactccctcgacaaaaccggaagtccaaccccactctaccgcgaccaactcgaccagtatgaagtcgaccacatcataccctactcattcttgccaatcgactcaatcgataataaagtgctaacccatagagaaaacaaccaacgaaagctcaacaacatcccggataaagagacagtcgccaacatgaaaccgttctgggaaaaactctataacgccaagctcatatcacaaacaaagtatcaacgactgaccaccagcgaacgcactccggacggggtgcttaccgaatccatgaaagccggtttcatagaacgccagctcgtcgaaacacgacaaattatcaaacacgtagcccggatactagacaacagattcctagacaccaaaatcatagcattaaagtcacagcttataacaaacttccgcaatacgttccacatagctaaaatccgggagctcaatgactatcaccacgcgcatgacgcgtacctagccgtggtcgtcggccagacactgctcaaggcataccccaagctagcacccgaactcatctatggccaccacgcacacttcaatcggcacgaagaaaacaaggccacgatccggaaacacctgtatagcaacatcatgcgattcttcaacaaccctgattctaaggtcagcaaagatatctgggactgcaatcgcgatctccccataatcaaagaggttatctacaactcccaagtcaactttgtcaaacgcactatgataaagaaaggcgctttctacaaccagaaccccgttggaaaattcaacaaacaaatcgcggcaaacaaccggtacccgttgaaaacgaaggtctcgagcctagatacatcgatctacggcggctatggccctatgaacagcgcgctttctatcatcatcatagcagaacgcttcaatgagaaaaagggcaagatcgaaaccgtcaaagagttccacgacatcttcatcatcgactacaagaaattcaacaataacccgttccagttcctgaacgacacatcggaaaatggatttcttaagaaaaataacataaatcgcgtcctagcattctacggagtccctaaatacagtctaatgcagaaaaacgacggcactaggatgctattcgaaagcaaaagcaacctccacaaagccactcaatttaaactcaccaaaacacaaaacgagctgtttttccacatgcggcgtctgctaaccaaatcaaacttaatggaccttaaatcagaatcagcaataaaagagtcccaaaactttatcctaaaacacaaggaggaatttgacaacatctcgaaccagctctccgcgttctcacagaaaatgctgggcgacaccacaagcctccgaaacctcataaagggctacaacgaacggaagatcaaggaaatcgactccagcgaagaagtcatcaaatacttttacgataacttcatcaaaatgttctcgtttgtaaagagcggggccccgaaggacatcaatgacttcttcaacaacaaatacacggttgcgagaatgcgccctaagccggacaagaaattcctaaacgccaccctcatacaccaatccataaccgggctctatgaaacccgaatcgacctatccaaactaggcgaagactga

SEQ ID NO: 6804 - RNA, 4263 nt, synthetic construct
  misc_feature 1..4263: note = Cas9 variant
  source 1..4263: mol_type = other RNA
atggcaaaatttaacaaaaactacagcatcggattagacatcggcgtcagctcagtcggctacgccgtggttacagaagactatcgagtcccggccttcaagttcaaagtcctaggcaatacggagaaagagaagattaaaaagaatctgatcggtagcacaaccttcgtccccgctcagtcagcccagggcaccagggtgttccgagtcaaccgacgccgaatcgaccgacgaaaccaccgcatagcatacctacgcgacatcttccaaaaggaaatcgaaaagatcgacaagaacttctacagacgactagacgagagcttcagggttctaggcgacaagtcagaagacattcaaataaaacagcccttctttgggaacaaggaactggaaaccgcataccacaagaagtatccaaccatatatcacctccgaaaacacttagcagacgcggacaaaaactcgcctgtagccgatattcgggaagtctacatggtactctcccatatacttaaataccgcggacacttcctcacattaggcaaaatcgacccaaacaacataaacatgcagaactcatggatagacttcattgaatcatgccaagacgcatttgacttagagatctccgacgaatccaaaaccattgccgccatattcaagagcagcgagaatagacaagaaaaggtcaagcagatcctatcctacttccaacaagaactcctgaaaaaggacaaaagcatatttaaacaactgctgcaacttctcttcggtctaaaaacaaagttcaaagattgcttcgagctcgaggaagaacccgaccttaacttctccaaggaaaactatgacgagaatctcgaaaacctgctaggcgccctcgaagaagacttcagcgatgtcttcgcgaaactcaaaattctacgcgacaccatactgctatcaagcatgctcacctacaccggcgcgacccacgccaggttctcggccaccatggtagagaggtacgaagaacaccgcaaagacctacaacgcttcaagtcattcgttaaacaaaacctcagcgagcaagactacctcgacatcttcggacgcaagacaccgaccggcttcgacgtcgacaaagagaccaaaggatacgtcggatatatctcaaacaagatggtcctcacgaacccacaaaaacagaagaccatccaacagaacttctacgactacatctcaggaaagatcaccggtatagagggcgcagaatgctttctcaacaaaatcagcgacggtaccttcctcaggaaactacggacaaccgacaacggcgctatccccaaccaaatacacgcatacgagctcgagaaaataatcgaacgccaagggcgagactacccatttctactggagaataaagacaaactactaagtatactcacgttcaagataccatactacgtcggcccgctagccaagggaaacaacagccgcttcgcctggataaaacggacgaccagccaagacgtcctcgacgacaacgacgaagacacgcgcaacggcaaaatccgcccgtggaactaccacaagctaataaacatggacgagacccgggacgcctttatcatcaacctgatcggcaacgacatcattctactcaacgaaaaggtactacccaaacgctcactgatctatgaagaagttatgctacaaaacgagctcacacgggtcaaatacaaagacaaatacggtaaaatacatttcttcaacagcgaactccggcaggagatcatcaacaacctatttaaaaccaattcaaagagagtctccagcgcgatgctcctctcctacctagaaaacttcaccaacctccaggcagtggaaatagtatccggcatcgagaaaggaaaatccctaaattccacactaaaaacctacaacgacctgaaaaccatattttcggaggagctgctagactcagaaatctaccaaaaggaacttgaggaaataatcaaagtaatcacggtcttcgacgacaagaaaagcatcaaaaactacctcacgaaatacttcggacacctggaatttctgaacgaggaaaagatcaaccaactctcgaaactccgatacacaggatgggggcgatactccgggaaactactgctgggtatccgcgacgaagacactggcttcaatctaatgcaattcctgcggaacgacgatgaaaaccgcaacctgacccaactaatctctgacacaaccctgagcttcgactccgcaattaaggccatccaatccaagagcaccgtcgaagacgatgtattcgaggaaatcaagaacctagccggctcccccgcaatcaaacgcgggatcctaaactccataaaaatcgtagacgagctagtacagataatcggataccctccccaaaatatcatcatcgaaatggccagagaaaacatgaccacagaagaggggcaaaagaaagcaaaaacccgcaaaagcaaactcgagtcggcactgaaaaacatagaagactcagtcctagaatccgggaaagtgccccactccgacgagcagctccaatccgaaaaactatatctgtattacctccaaaacggaaaagacatgtattccctcgacaaaacaggaagccccacacccctctatcgagaccagctcgaccagtacgaggtcgaccacatcatcccctattcatttctccccatcgattcaatagacaacaaggtcctgacccaccgcgaaaacaaccagagaaaacttaacaacataccagacaaagaaacagtcgcaaacatgaaacctttctgggaaaaactttacaacgccaagctgatctcccaaaccaagtaccagcgactcacaacgagcgaacgcacccctgacggcgttctgaccgaaagcatgaaagccggcttcatcgagcgccagctcgtcgagacccgacaaatcatcaagcacgtcgcacgcatactcgataacagatttagcgacacaaagataataacccttaaatcccagctagtcaccaacttccggaacaccttccacatagccaaaatcagagagctaaacgactaccaccacgcacacgacgcgtacttggccgtggtcgtcggccaaacccttctaaaggcttatccgaagctcgcgccagaactcatatacggacatcacgcccacttcaaccggcacgaagagaacaaagcaactcttcgaaaacacctctacagcaacatcatgcgattcttcaacaaccccgacagcaaagtatccaaagacatttgggactgcaaccgggacctgcccatcgtaaaagatgtaatatacaactcacaaataaatttcgtcaaacgcacaatgattaagaaaggtgccttctacaatcaaaacccggtcgggaaactaaacaaacagatcgctgccaacaacagatacccattaaaaaccaaagtgtcttcgttagacaccagcatttatggaggctacggacctatgaacagcgcactgtcgatcataataatcgccgaaaggttcaatgagaaaaagggcaagatagagaccgtgaaagagtttcatgacatcttcattatcgactacgagaaatttaacaacaatccgttccagttcctgaacaacgtgtcagaggagggcttcctcaaaaagaacgacttaaacagagtcctagcgttctacaggatcagtaagtacagcttaatgcagaaaatcgacggcacacggatgctattcgaaagcaagagcaacctccataaagtcacccagttcaaactcactaaaacccagaatgaactatttttccatatgaagcgactattgaccaagtccaacctcatggacctgaaatcagaatcagccattaaggaaagccaaaacttcatccagacccaccagaacgagttcgacaacatcgcggaccgtctatcgaattacagtcagaaaatgctcggcgaaaccaagtcgctccaaaccttaatcaacggttacaatgaacgccccatcaaacaaatcgacaacaacgaagaaaccatacgatactactacgacaacttcataaaaatgttttccttcgttaaaagtggagccccaaaggacatcataaacttcttcaatgacaaatatacagttccccgaatgcgccccaaacctgacagaaaaatgctcgacgcaaccctcatccaccagtccataactgggctatacgaaacccgcatagacctctccaaacttggcgaagactga

SEQ ID NO: 6805 - RNA, 4263 nt, synthetic construct
  misc_feature 1..4263: note = Cas9 variant
  source 1..4263: mol_type = other RNA
atgagccgcaaaaactacgtcgacgactacgcaatcagcctcgacattggcaacgcatcagtcggttggtccgccttcacgccgaattatcgactcgtacgcgcaaaaggacacgaattgatcggagtcagactcttcgacccagccgatactgcggagagccgaaggatggcacggacaacaagacggcgctattcaagaaggcgatggcgtttgaggctcctcgacgccctcttcgaccaagcactcagcgagatagacccgagcttccttgcccgccgcaaatactcatgggtccaccccgatgacgaaaacaacgccgactgctggtacgggagtgtactattcgactcgaatgagcaagataaacgcttttacgaaaagtaccccacaatataccacttaagaaaagcgctcatggaggatgactctcaacacgacatacgggagatctacctcgctatccaccacatggtgaaatacagaggaaacttcctggtggaaggcactctcgaaagtagcaatgccttcaaagaggacgagttgctcaaactactgggccgcatcacgcgatacgagatgagcgagggagagcaaaactcagatatagagcaagacgatgagaacaagctcgtagcccccgccaacggacagctcgcagacgccctgtgcgcaacccgggggtcccgctcgatgagagttgacaacgccctcgaggccctcagtgccgtaaacgatctaagccgagaacagagagccatcgtaaaggccatattcgctggactcgaggggaacaagctcgacctcgccaaaattttcgtaagcaaagaatttagctcggaaaacaagaaaatcttgggaatatacttcaacaaaagcgattacgaagaaaaatgcgtacagatagtcgactcaggtctactggacgacgaagaacgagagttcctggatcgcatgcaaggccagtacaacgccattgccctaaaacagctgctaggaaggtcaaccagcgtgtcagatagcaaatgcgcaagctacgacgcccaccgcgccaattggaacctgatcaaactgcaactacgcaccaaggaaaacgagaaggacataaatgaaaactatggaatcctagtgggctggaagatagactccgggcaacgcaaatcagtaagaggagaaagcgcctatgaaaacatgcgcaagaaagcgaacgtattcttcaaaaagatgatcgaaacatcagacctttcggagaccgacaaaaaccgcctgatacacgacatcgaggaggacaaactatttccaatacagcgcgactccgacaatggcgtaataccgcatcaactgcaccaaaacgagctcaagcaaatcattaaaaagcaaggcaaatattaccccttcctgttggacgcgttcgagaaagacggcaaacagatcaataaaatcgaaggtctcctgaccttccgcgtcccctacttcgttggcccactggtcgtccccgaagacttacaaaagagcgacaacagcgaaaatcactggatggtccgtaaaaagaaaggtgagatcaccccatggaacttcgatgagatggtagacaaagacgcaagcgggcgaaaatttatcgaaagactggtaggcactgactcatacctactcggagaacccacgctaccgaaaaactccctattgtaccaggagtatgaagtgctaaacgaactcaacaacgtgaggctatcagtccgaaccggaaaccactggaacgacaaacgaaggatgcgactcggccgcgaagagaaaactctactatgccaacgcctattcatgaagggccagacggtcaccaagaggaccgccgaaaacctgttaagaaaagaatacgggcgtacctacgagttaagtggcctgtccgacgaatccaaatttacatccagtctatccacctatgggaaaatgtgtagaatattcggcgaaaaatacgtaaacgaacaccgtgacctcatggagaaaatcgttgaactacaaacggtattcgaggataaagagacattgctccaccaactccggcaactagaaggcatctcggaagcagactgcgcacttctggtaaacacgcactacaccggctggggccggctatcaagaaaactactgaccacaaaagccggagagtgcaagatatccgacgacttcgctccccggaagcactccataatcgaaatcatgcgagccgaagaccgcaatctaatggaaataatcacagacaagcaacttggcttcagcgactggattgaacaggaaaacctaggagccgaaaacggaagcagcttaatggaagtggtcgacgacctccgagtatcaccgaaagtgaaacgaggcatcatccagtccatacgattaatagacgacataagcaaggcagttggtaaacgcccatcacgcatcttcctcgaactagctgacgacatacaaccatccggaagaacgatcagccgcaaatcgagactccaggacctgtaccgcaacgcaaatctaggaaaagagttcaagggaatcgcagacgaactcaacgcatgctccgacaaagacctacaagacgacagactgttcctatactacacgcaactgggaaaggacatgtacacaggagaagaactcgacctagacagactgagctccgcctacgacatcgaccacatcatacctcaagcagtcacacagaacgacagcatagacaacagggtcctagtagcaagagcagaaaatgcacgaaaaacagatagcttcacgtacatgccccaaatagcagacagaatgcgaaacttctggcaaatcttactggataacggtttaataagccgagtcaaattcgaaagactaaccagacagaatgagttcagtgaacgagaaaaagaaagattcgtccaacgctccctggtcgaaacgcgccaaataatgaagaatgtggcaaccctaatgcggcagcgctatggcaacagtgccgcggtaattggtctaaatgcggaactaacaaaagaaatgcatagatatctcggcttctcccacaaaaacagagacataaacgactaccaccacgcacaggacgcactctgtgtagggatagcgggccagtttgcggccaaccgcgggttcttcgcagacggagaagtgagcgacggcgcacagaacagctacaatcaatacctacgggactatttaagggggtaccgagaaaagctaagcgccgaagacaggaaacaaggccgtgctttcggcttcatcgtaggctcgatgagatcccaggacgaacaaaaacgcgtaaaccctcgcaccggcgaagtcgtgtggagtgaagaggacaaagactatctacgcaaggtcatgaactaccgaaaaatgcttgtcacccagaaagtgggagacgacttcggagccttgtacgatgaaacgcgatacgcagcgacggacccgaaaggcataaaagggatacccttcgacggagctaaacaagacacctccctctacggcggctttagttcagcaaagcccgcctacgccgtcctcatcgaaagcaaaggcaagacacgcctagtcaacgtaaccatgcaagagtactcactcctcggggaccgtccaagcgacgacgaactcagaaaggtattagccaagaaaaagagtgaatacgccaaagcgaacatattgctacggcatgtgccaaaaatgcagctgatacgatacggaggcggactaatggtaattaaaagtgccggggaactgaacaacgcacaacaactatggctaccctacgaagaatactgctacttcgacgatctcagccagggcaaaggatccctcgaaaaagacgacctcaaaaagctactagactccatcctggggtcggtccaatgcctgtacccctggcaccggttcaccgaggaagaactggcggacttacacgtagccttcgacaagctccccgaagatgagaaaaagaatgtaataaccggaatagtctccgcactgcacgcggacgctaaaaccgccaacctcagtatcgtcggaatgactggatcatggcgacgcatgaacaacaaaagcggctacaccttctccgacgaagacgagtttatatttcaatccccatcaggcctattcgaaaagcgggtaacagtaggagaactaaagcgcaaggccaagaaggaagtgaactccaagtaccgaaccaacgagaagcggctaccgacactaagcggagcatcgcaaccgtga

SEQ ID NO: 6806 - RNA, 4263 nt, synthetic construct
  misc_feature 1..4263: note = Cas9 variant
  source 1..4263: mol_type = other RNA
atggccaagccaaaggattacacgatcggactagacattggcactaactctgtaggctgggtagtcactgatgatcagaacaatatcctccggataaaaggtaaaaaggcgatcggggcgcgcctattcgccgaaggcaaagtcgcggcagagcgcagaagttttcgcaccacgaggagacgaataagtcgcagacgctggcggataaagctgctagaagaactattcgatgaggaaatcgcaaaagtcgacccatccttcttcgcccgtctccacgaatcctggataagtccaaaagacaaacggaaaagatactccgcaatagttttccctagtccagaggaagacaagaaattccacgagagttaccccaccatctatcatctccgagacaaactaatgaaggatgaccaaaagcacgacatacgcgaaatctacatcgccgtacaccaaatgataaaagtcaggggcaacttcctacacgacgaaagtgtagagacgtaccggtcaggtatgagctcactcggtgggcgctccgagcgaaccatcctaagtgtacaaaccctggaagaactaaatgatttgttcgcggaaaatgaagggacggaagaagtcgaattaaacgtcgcgtctgccgaacaaatcaacgacatccttacgggggaccacctaaacgcggacagccaaaaagaaataagcaacctgctgctaccgtcctcgttcccgtcattcgacgacaaggcgaaagaaaaacaagtcaagaaactgattaataatgtagcaacaaacatctcaaaagcgtggctcggctacaaagcagacttctcaaccatcctaaacctggcgaaagtcgacaaagaccagaaaaagatcttcgcattcgccctccaaggcggcgacgaagaggataaggttcaagaactcgaaagcctcctcgaacaaagccaaacggacatcgtagaccgcctaattgaaatcagacacgccatcgtactgagcgaaattgtgccggtcggaatgacattaagcgaggccatgatagacaaatacgaccaacacaaggaagacctaataaccctgaaggccgtaatccgcaacacaaaagacaagaagaaagcagccaaactgcaggcgatatatgacctatacgtgaataaccgacacgccgacctggccaaagccatgaaactaacgggtatcaagaaaaggtccgaattactagaccccgaagaactcaagaaagccataagttccctgctggacgacagcccagaagccggtgagataaaacaacgcctcgaggggaaaaccttcctaccgttgcaacgtagcaacaacaacggcgtcatcccaaaccagctacaccaagtggaactagatgaaataataaagaaacaatcaaaatattacccattcctagccgagaaaaaccccgacgaatccgaagaggcacagaagaaagctccgaccaaactcgacgccctactcacctttagagtaccgtactacgtaggcccaatgatcaccaaagaggaacaagaagcacaagacggtcattcgttcgcctggatggttcgacgcgacccccaagaccacgaagcaatcacaccttggaacttcgaaaagaaagtagacaaaatggctagcgccacccagttcataaaacgaatgaccacaaaagacacgtacctcctgggagaggacgtactccccgcaagcagcctaaaataccaactcttcaccgtcctcaacgaactcaacaacctgcgcgtcaatggcaagaaactcacgtcggacgaaaaagaacaggtgatagaaggactgttcaagaaacagaaaaccgtgaaagctgacaaattcgtcaaatactggcaagccatacacataggcgcagacataaaagtcaaaggacttagtgaccctagcaaattcaacagtacgatgtcgacctacatcgacttcaaaaagatttttggcgaccaactcaacgacgcaaacagacaaaacgatttcgagaaaatcatcgaatacagcacaatcttcgaagaccgaaagatcctagaagacaaacttcgagccgacttcgcgtggctcagcgaagaacaaatcaagcaactgtgtcggctccggctacagggatggggacgcctcagcgacaaacttctcacccggctcaccgatgccgacgggcaaaacgtcctggaacgactatggaactccaatgataactttgtccaaatagtctctgatccaaacataaaagccaaaatcgagcaggagaaccagaaactgctgcgggatggccagtcggacgacgccgtcgaatccattctagacgacgcctacacctcaccacaaaacaaaaaggcaatccgacaggtaatgcgggtcgtgcacgatattgtaaaagcgtgcgacggcaacgtaccggccaagttcgccatcgaatttgctcgctcacaagaagacgacccgaaacgaacaaccgcacgggtaaaccagatgcagaaaatatacgaccaaatcagcgacgaagtcgtcagccaaggcgtcaaagaacaactatcaggcatgaagagtctcaaagaccgctactacctgtacttcatgcaagggggaagagacgcctacaccggcgcaaaactcaacatagaccgactcagtgactacgatatcgaccacatcatgcctcagagctttgtaaaagacgactccctagacaaccgcgtcctcgtagcacgggccgtcaacaaccaaaagagtgacaaggtccccgcattcctattcgggaacaaggtggtcgcggacctagggatcacagtccgcgagatgtgggacaaatggcaaaaactcggtatgatatcaaaaaggaagctatctaacctcctcaccgaccccgacgcgctgactgagtaccgagcccaaggattcatacgccgccaattggtcgagacctcacaagtaataaaactgaccgccacgatactccaaagcgagttcccagacagtaaaatcatagaagtccccgcaaaatacaacagcatagtccgcaaacagttcgacctatacaaatctcgagaagttaacgattttcaccatgccatcgacgcgtatctttcaacgatcgtcggaaactatctctaccaagtgtaccccaacttgagacgcatgtttgtatatggcgagttcaagaaattcagctcaaacgccgaagaaagcgcccacgacatggctagaagagtaaaatccatgaactttctagatgacctcctccgaggcacacacggagacaacatctactgccgctcgaccggagagatcgtgttcaacagaaacgacataatctcgaaactcaaacaagcatactccttcaagcagatgctcgttacacaagaagtcttcacccgcaaaagcgctctattcgaccaaactgtatacccatccccggagagggactcaaagaaacgtagcggcctaatcccccgtaagaaaggaatggacaccgaaatctacgggggctactccggtaacaaagacgcctacttcgtcctagccgaagccgtgaaagaaaaagggcacactctccagatagttggagtcccaatacgggctctcaacaccctcaaaaacagcgcaaactactcggagaagctattagaaataatcaagccccaagtcatgtttaacaagaaaaatgggaaaccgaagaaaggtgtcaacgatgtacgaatcctgatggataacattccttacagacaaccggtactcgaaggcggcgccctatacatgctcgggagtagcacctacaaatacagcctcaaacaaatcacgctgagccaggagtcgatgaaatacatcctcgactacatcgacgacccctccttcaacaaacacattatggtaaacatagatcaccaggacgaaaagaaatgcctactatccgtatacgacgaaatactcgacaaaatggataaatacctgccgttattcgacatcaacggcttccgcaagaaactacacgacggccgcgagaaattcgtcaaactacccgtagagaaacaagccgaagtagttaaagacattctccgcggccttcatgcaaacagcgaaatgacaaagcccagcgacctaggcttgacgaccgcgctcggattcatgcaagccccagacggaataaaaatctctgacgacgccgtcttcatctaccaaagtcccaccgggctgttcgaaaggcgcgttaaagttagtgacctactcaaatga

SEQ ID NO: 6807 - RNA, 4266 nt, synthetic construct
  misc_feature 1..4266: note = Cas9 variant
  source 1..4266: mol_type = other RNA
atgacaaaattcaataaaaactactcaatcgggttggacataggagtcagctcagtcgggtacgccgttgtcactgaggactaccgagtcccagccttcaagttcaaagtgctgggcaacactgaaaaagagaagatcaaaaagaacctcatcggcagcacaaccttcgtctcagcccagcccgccaaaggcacccgcgtattccgcgtcaatcgacgaagaatagaccgacgaaaccatcgcatcacctacctaagagatatattccagaaggaaatcgaaaaagtcgacaaaaacttctaccgtcgactcgacgagagcttcagagtgctcggcgacaagagcgaggacctccaaatcaaacagccctttttcggagacaaagaactcgaaacagcctaccacaagaaataccccaccatttaccacctacgcaagcatctcgcggacgcggacaaaaatagccccgtcgcggacatccgcgaagtttacatggccatatcacacatcctaaaatataggggtcatttcctcacactcgacaagatcaacccgaataacataaacatgcaaaactcgtggatagacttcatcgaatcatgccaagaggtattcgacttagagatatccgacgagagcaaaaacatcgcggacatcttcaagtcatcagaaaaccgccaggaaaaagtcaagaaaatccttccctatttccaacaagaactactgaagaaagacaaatccattttcaaacagctgctacagcttctctttggcctaaaaaccaagttcaaagactgcttcgagctcgaagaggaacccgacctaaacttcagcaaagagaactacgatgagaaccttgaaaatttcctcggctcactcgaagaggacttctccgacgtcttcgccaaactaaaagtccttagagacaccatcctactatccggaatgcttacctacacaggagctacccacgcccggttctcggcaacgatggtagaaagatacgaggagcaccgcaaagatctccaacggttcaaattcttcataaagcaaaacctcagcgaacaggactacttggacatcttcgggcgcaagacgcaaaacgggtttgacgtcgacaaagagaccaaagggtacgtcggctacatcaccaacaagatggtcctcactaacccacaaaaacagaagaccatacagcaaaacttttacgactacatctccggaaaaattactggcatcgagggcgccgaatacttcctcaataaaatctccgacggcaccttccttcggaagctccgaacctccgacaacggcgccataccaaaccaaatccacgcctacgaacttgagaaaataatcgaacggcaaggaaaggactacccgttcctcctcgaaaataaagataaactgctctcaatcctcacattcaagataccctactacgtgggcccgctcgccaaaggttcaaacagccgtttcgcctggatcaagcgcgccacgtcatcagacatcctcgacgacaacgacgaagacacgagaaacgggaaaatacgaccctggaactaccaaaaactgattaacatggacgaaacccgtgacgctttcataaccaacctcattggcaacgacattattttgctcaacgaaaaagtcctaccaaaacgctccctaatctacgaagaagtgatgctccaaaacgaactaacccgggtcaaatataaagacaaatacggtaaggcccacttcttcgatagcgagctccgacaaaacatcatcaatggactattcaaaaacaactctaaacgcgtcaacgcaaaatccctaatcaaatacctctccgataaccacaaggacctcaacgccatagaaatcgtctccggtgtagaaaaaggaaaatccttcaactcgacgctaaaaacttacaacgacctaaaaacaattttctccgaggaattactcgactccgaaatctaccaaaaggaacttgaagagataatcaaagtcatcaccgtcttcgacgacaagaaatccatcaaaaactacctcactaagttcttcggccacctggaaatcttagacgaggagaaaataaatcaactcagtaaactccgctactccggctggggccgttactcagctaaactcttgttggatataagagacgaagacacaggcttcaatttgctgcagttcctccgaaacgacgaagaaaaccgcaatctaaccaagttaatatcggacaacacactcagcttcgaaccgaaaatcaaagacatccaaagtaagagcaccatcgaagatgacatcttcgatgaaataaagaaactcgccggatcgccagccatcaaacgagggattctcaacagcatcaaaatagtagacgaactcgtccagatcatcggctacccaccccacaacatagttatagaaatggcgagagaaaacatgaccacagaagagggtcagaaaaaggccaaaacgcgtaaaacaaaactagaatcggcgttaaagaacatcgagaactccctactcgaaaatgggaaagtcccccactcggacgagcagttacagagtgaaaaactctacctctactacctccagaatggcaaggacatgtacaccctcgacaaaacgggctcccccgctcccctgtacctcgaccaactggaccaatacgaggtagatcacatcatcccatacagcttcctaccaatcgactcgattgacaacaaagtcctcacgcatcgggaaaacaaccaacagaaactcaacaacataccggacaaagagacggtcgccaacatgaaaccgttctgggaaaaactctacaacgcaaaactcatatcccaaaccaagtaccaaagattgaccacgagtgagcgcactcccgacggcgtgctcacagaaagcatgaaagcggggttcatcgaaagacaactcgtagaaactcgacaaatcataaaacacgtagcacgcatcctcgataaccgattctcggataccaaaattattactctgaaaagccagctgatcaccaatttccgcaacactttccacatcgcgaaaatacgcgaactcaatgactatcaccacgcacacgacgcctatctcgccgtagtcgtaggacagaccctactcaaggtctaccccaaactcgcgcctgagctaatttacggccaccacgcccactttaaccgacatgaagagaacaaagccacgctacgtaagcacctctactccaacatcatgcgtttcttcaataaccccgactccaaggtctcgaaagatatctgggactgcaaccgagacctgccgatcatcaaagacgtgatctacaactcgcaaatcaacttcgtaaaacggaccatgatcaaaaagggcgcgttctacaaccagaaccccgtcggtaaattcaacaaacagctagccgccaacaaccggtacccccttaagaccaaagccctatgcctcgacacatcgatctacggcggatacggccctatgaactcagccctctccatcataatcatagcggagcgctttaatgaaaagaaaggcaaaatagaaaccgtaaaagagttccatgacattttcataatcgactatgaaaaattcaacaacaatcccttccaattccttaacgacacgagtgaaaacggattccttaagaaaaacaacataaaccgagtcctaggcttctaccggattccaaaatactccctcatgcagaaaatcgacggcacgcgaatgttattcgaaagcaaaagcaacctccataaggccacacaattcaagctaactaagacccagaatgaactcttcttccacatgaagcgcttgctaacaaagagcaacctaatggacctgaaaagcaaaagcgccatcaaagaatcccaaaacttcatactaaagcacaaagaagagttcgacaacatctccaaccaactcagcgcgttttcccaaaagatgctaggcaatactacgtccctaaagaacctcataaaaggatataacgaacgaaaaataaaggaaatcgatatccgggacgaaacgattaaatacttctatgacaacttcatcaagatgttttccttcgttaaaagcggcgcccctaaagacatcaacgacttctttgacaacaaatgcaccgttgcgcgaatgagaccaaagcctgacaagaaacttctcaacgcaaccctgatccaccaatccataaccgggctgtatgaaacacgtatagacctatccaaactgggggaagactga

SEQ ID NO: 6808 - RNA, 4266 nt, synthetic construct
  misc_feature 1..4266: note = Cas9 variant
  source 1..4266: mol_type = other RNA
atgaagaaaatactaggcctcgatcttggcccaaacagcataggctgggccctagtaaacgaagccgagaacgaaaacgaaaaatctagcatcataaagataggctcccgcgtcatccattacggagataacctagtgaaagttgacaaatcggggaagatcagcgccagcatgacgccggaggaagacttcagctccgggaaggggctcagtcccaacgcaggaaggacgaaacaacgcagcgcccgacgaaatctccagcggtacaaacagagacggaacaacctcattgaaatactcaaagcgcactcacttatcgacaacaatttcattttcagcgaggaaggaaacgagaccacattcaagacctacaagaaccgcgccctagcagcgacaaacgaaatatcgttagaggacttcattaaagtactgttcatgatcaacaagaaacgggggtacaaatcaagccgaaaagccaaaggagacgaagacggccagctaattgacggcatggccattgctatccagctttacgagcacaatcagaccccgggacagttcgtttacaacctcctcaaaaacggaaagaaaaacatcccagacttctacaggagcgacctacagaccgagttcgaccgcatatggaacttccaaaaagccttccaccaagagagcttgtctgacggcatatgcgaaaagctagtcggccaaaagaaaaacgtcactagcgccatactcttcaaagagttcaaaatcgaaagcctcgagatcaagggaaaatgggacgagaagcgcttcttcaggtatgaactgagaaacaaagccgtacaacaggaactaaaactcaacgaaatcgcagaatgcctcgtcgaaatcaatggcgaaatatcaaacagctccgggtacctcggggccataagcgaccgatcgaaggagctcgtcttccaaaagattacagtgggccagtatctctacaaacagatcgcggcaaaccccaacacgtctttgaagaaacaaatattctaccgccaggactacctggacgagttcaacaccctctgggaaacgcaagccaaataccacaaagaactcaccgacgagcttaaaacccagatcagagacgtcataatattctaccaaaggcgtctaaagtcgcaaaaagggctcattagcttctgcgagttcgaatcgaaacagatcgaggttttcgtcgacgggaaaaagagcataaagacccgcgggatgcgggtcattccaaagtcttcacccctgtttcaagagttcaaaatatggcagatcctaaacaatatagaaatcacagacctcaaaacgaaagagtccagagagctaacagacgacgaacgccaactcctgtttgaggaactcaacatacggcccaaaatctccaagaaagaggccctaaagattctcacggaaaaacctgctcaatacgacctgaactacaaagatatagagggcaacaaaacgaacgccaaattctacgaggcttacaacaagataatccacctgtccggacacgacgaaatcgacttcaccgacaaaacatcggacatcaacgagtatctaaagcaaatcttcagtctccttggcataaaaccagaaatcctcgacttcgattcatcccttaaagacgaagacttcgaaaaacagttacacttccaactctggcacctgttgtactcattcgaaggcgacaataccaaaaccggagacgaaaaactactccaaaagctaaacaccaagttcgggttcccagtcgaatacgccaaagtgatcagcaacatagccctaccggacgactatggatcgctctcagcgaaggcaatccgaaaaatccttccgcatctaaaagacgggttttcgtacggcggcagaaagagcaggccggacgaacccagcgcatgcgaatacgcggggtaccgccattcaaaggcatccctaaccaaggacgaaaaagagaacaagacctataaagataagctagaaatactacccaaaaactcacttcgtaaccccatagtggagaaaatactaaaccaaacgattaatgtcgtcaatgcagtcattggtgactacgggaagcccgacgaaatccggctcgaactagcgcgggagctgaagaagagtgccgaggaacggcaggacgccacagactccatttcaaaagcaactgctaaacacgaaaaataccgaaaagtcttacaaaccgagttcgggctcaaacacatcagtcgcaacgacctaatccgatacaagctgtaccttgaactgaaaaacaacggtttcaaaaccctatactccgatacctacatcgcgccgtacgaaattttcagcaaaaagtttgacatcgaacatatcctccccaaagcaaaactcttcgatgactctttctcaaacaaaacgctagaactaaagtccgtcaacctgaagaaaggcgacatgacggcatacgacttcgttaaagaggagtacgggacagaggggctagctaaatacgagcaaagagtacaagacctattcctgaataagaaacgtaacgaggaccttgaccaagaaaacgaatcccgaataacagacgagaaaatctcgaaaacgaaacgcgacaaacttctcatgccagaaaataaaatccccaccggcttcatcgaccgcgaactgagagacagccaatacatagcgaagaaagccaaaaccatgatggaggacatctgcaaagacgtggtcacaaccaccggatcggttacagatcgtctgcgagaagactggcagctcatagacatcatgcaggaactaaactggcccaaatacgcagcgctgggattaacggaagagttcacaaatgaagaaggcaacgtaatccgaaaaatcaaagattggaccaaaaggaacgaccaccgacaccacgcaatggacgcgataacaatagcgttcacaaaacgtagccacatacaatacctaaacaatctcagtgcacggagcgacaaatccagctccatctacggcatcgaacaaaaggaactatatcgtgacaaaaacaataaactaagatttgccccacccatccccatcaacgaatttcgcgccgaggccaagatgcaactcgaaaatacactaattagcataaaggcccaaaataaggtcgtcacgaaaaataaaaataagatctcggggcaaaagaaactgcaagaaacacttacaccccggggacaactccatctagaaaccatctacggcaaaataaatcaatatcagaccgcggaaataaaagtcggagggacgctagacagtgaactgataaacaaagtcgcgaacaagaaaaccagagaagcactcctgaaccgtctcgcagagttcggaaacgaccccaaaaaggctttcacagtcaaaaacacaatagacaaaaaccccatctatctggacaaacaccaatcctacaaaatccccgagaaagtcaaaatcgtgtggcaagaaccagtctacaccatacgcaaatcaataacaccggacctgaaactcgacaagataatcgaccccaagatcaaagctctgctcgagagccgccttaaagagtgcaatggagacgcaaaactcgccttcagtaacctagccgagaatcccatttggctcaacaaagaaaaagggatccaaatcaaacgtgtcacgatcaccggtatctcaaacgccgcgtcactacacgacaagaaagatctcaacgggaaacctatactggatgaaaaaggaaacaaaatatccgttgacttcgtgaacacaggaaacaaccaccacgtggccatctacaaagacgaaaatggaaacctccacgacaatgtcgttacatttttcgaagctgtagaaagagtcaaccaaaacctgcccgtagtagacaaattattcaaacagaaagaagggtggcaattcctattcaccatgaagcaaaacgagtacttcgtgtttcccaacgagatcacagccttcaacccaaatgagttcgacctcctgaacccggacaactactacctcatatcccccaatctcttccgtgtccaaacaatgagcaaagtcatgtacggcaacaacaccctccgcgactacaagttcaggcaccaccttgaaacgacactccaggacatcaaggaattgcgagacatagtattcaaacaattcaaaagcctgtccatattcgacaagatagtcaaagtccgtatcaaccacctcggcaagatcgtcaaaacaggggaatactga

SEQ ID NO: 6809 - RNA, 4266 nt, synthetic construct
  misc_feature 1..4266: note = Cas9 variant
  source 1..4266: mol_type = other RNA
atgaaggacatacttgggctagacctaggtacaaactcaatcggttgggctgtcgtcaaagaagcccaaaacgacaatgagcaaagcgagatagtagacgtcggcgtccgagtcaacccgctcacaacagatgaaaagacgaatttcgaaaaaggcaaacccataagcacaaacgctgaccgcacactaaagcgctccgcacgcaggaatctccaacgctacaaactccgacgaaaggaactgatagaactactaaaagaacaccaactcatctccactgacacaatcctcaccgaaaatggaaaagggaccacattccaaacgctagaactccgcgcgaagtcggccaaagagaaaataagcctggaagaactggcacgcgttttcctcaccatcaataagaaacgcggctacaaatcgagccggaaagccaaaaacgaggacgaagggcagctgattgatggcatggaaatcgcaaagcggctatacgaagaaaacctcacaacaggtcaactctcccttcagctgctgaaagaaggtaagaaatcgctaccagactattacagatctgacttacaattcgagctcgacaaggtatggaacttccaaaaacagtttcacagccacatcctgacagacgagttctacgcacaactgaagggcaaaggacaacgtgccacatcagctctgttcctggcaaaataccagatctacaccgcggaaaacaaaggttcccgggaagacaaaaagctccaggcataccaatggagagtcgacgccctgagcaaagaattgacccgcgaacagcttgcattcgtcataaccgaaatcaacaacaacctcaacaacagcagcggctacctaggcgccatctcagacaggagcaaagaactatatttcaacaacgaaacagtaggggaatacctctggaaacagatcgccgcgaatccgcacacatcactgaaaaaccaggtgttctaccggcaggactacctagatgagttcgaacaaatatggaaaacacaaagtgccttttaccccgaaatcctcacagaaagcctgaagaaagaactacgagacgtggtgatattttaccaacgcaaactcaaaagtcagaaaagcctagtttccttctgcgagtttgaaaacaaagaaatagaaataaagaaagaagacggaacatccaccaagaaagtcatcggcctgaaagtggcaccaaaaagcagcccgcttttccaagagttcaaaatctggcaaaacctcaacaacgtcttaatccgcaagaaagggagcaaaacgaagaaagccgccaaaaaccaacaagctgtactcttcgaggaggagaaaaccattagtgagcttgacctggaggctaaacaggcactcttcaacgagctcaacctgaaaggaaacctcaaagcagattactgcttggaaatcctcggctactcaccaaaagaatgggagatgaattacagcgtgctcgaagggaacaggaccaacaaagccctatacgaagcctatctgaaaataacggacctcgagggatacgacgccaagaaccatctgaaggtaaagctcaacaaggacgaagtcgagctcgacgacttaaaagtcccggcgagcgagataaaagatatggtccaggccatattcaaagaagccggcataaacaccgacatcctccacttcaacgccgagctcgacgggaaagacttcgagaaccaggcaagctaccagttatggcacctgttatactcgtacgaaggggacgactccaaatcggggaacgaactcctatacaaactgctggaaactaaattcggcttcaagaaggaatacgcccaaatccttgccaacgtctccctgtcagacgactacggctccttatccacaaaagcaatgcgaaaaatccacccgtacataaaggagaacaaatttagcacggcatgcgagttagcaggataccggcactcgaagcactccctcacaaaggaagagaacgacaaccgcgtactacgagactccctggaggttctcaaaaagaactccctccgacaacccgtcgtagaaaagatactcaaccaaatgatcaatctggtgaacgcactactgaaaaagtaccgcaccgagaacccgaacttcaaattcgacgaaataaggatagaattagcccgcgaacttaagaaaaacgcagaggagcgagctaacatgaccgcaaacatcaataaagctaaaaccgaacatgagaaaatcataaaaatcctgaagaacgagttcggactccccaaccccacacggaacgacataataagataccgcttgtatgaagaactcaaagcaaacgggtacaaagacctgtataccaacataaaaatcccccaagagaagctctttacaaaagagattgacatcgaacacatcatccctaaatcccgagtcttcgatgattcattctcgaacaaaaccctttcattccggaagacgaatctagacaaaggggaacgaacggccttcgactacatggaatcaaagttcggcgccgataagctcgaagaatacgtagcacgagtagaggacttatacaagaacaacatcataagcaaagccaagtatcaaaaattactgaagaaagaatcagaaattggagacgggttcgtcgaacgagaccttagggaaacccaatacatagccaagaaggcaaaagaaatacttctacaaattacacccaacgttctatccaccagcggcggtataaccgaccgcctccgggaagactgggacctcatcaacgtgatgaaagagctaaacctaccgaaataccgagccctcggccttaccgaaatggaggaccgaaagtatggccaacaagtcgaggtcatcatcgattggacaaagcgcaacgaccaccggcatcatgccatggacgcgctcaccgtcgcatttacgaaacacaaccacatccagtacctcaactacctcaatgcgcgaaagaacgaaaaacacaaagagcacagtaacatcatgggcattcaacaactagaaaccataaaagtaacggacaaaaacggaaacgagaagcgagtattcaaagcgcccatgccaaatttccgacaggtaaccaaagcattcttagaaaatatactcataagccacaaagcgaaaaacaaagtagtcacaaagaacaaaaacaaagtagcagggtcgaacaaagtacaggaagtcctgaccccgcgaggccaactacacaaagaaacagtctacggcaagtatcagtactacgtgcaaaaagaagagaaaatcgggggtaagttcgatctcgaaacgataaagaaagtagccaaccccctgtaccagagcctgctcaaaaagcgactggaagagaacgggggcgaccccaagaaagcatttaccggcaaaaactccctcgccaaaaacccaatctacctcgatgacgcgcagaccgaacaactccccgagaaagtcaaattggtttggctagaaaacagcttctccatacgcaaagacatcacgcccgagaacttcaaagacgaaaaactcatcgacaaaatcctagacgaaggcgtgaagaggattctaaaagaaagactacagtcattcggcaatgacgccaagaaggcctttagcgacttagagaaaaaccccatttggttaaacaaagaaaaagggatcacaataaagcgcgtcacgatttcaggcgtcgccaacgcagaacccctgcataccaaaaaggaccacctgggcaaggaaatacttgacaaagagggaaaaccgatcccagtagatttcatctcaacaggcagcaaccaccacgtggcagtgtaccgcgacgagaagggcaacctgcaagagaaagtagtatcggtcttcgaagctgttgtcagggcaaaccagggactccctatcatcgacaagacatacaaccaacacctcggctgggagttcctattcaccatgaaacaaaatgaaatgttcgtcttcccaaacgagtccaccggattcaacccgaacgatatagatctcctcgatccaaagaacaaacgaataatttcgcccaacctattccgcgtccaaaaactcgcgactggcgactactggttccgacaccacctcgagacaacagtcgagacaaagagcgcaaccaaggacatgacgtataaacgcctatccctaaaccacatcaaaaacataatcaaggtaagaatctcacacctaggggacatcgtctccgtcggggagtactga

SEQ ID NO: 6810 - RNA, 4275 nt, synthetic construct
  misc_feature 1..4275: note = Cas9 variant
  source 1..4275: mol_type = other RNA
atgaagcgaatcctgggattagacttggggacaaactcgatcggctgggccctagtcaacgaggcagaaaccgacgaggaggtctccagcatcatacgactcggcgtacgtgtaaaccccctaacagttgacgagacgcagaacttcgaaaaagggaaaagcatcacgacaaatgcagaaaggacgctaaaacggtccatgcgaaggaacttacaaagatataaactcaggcgcgacgcgctggtagagttcctaaaagaactaggattcatcacagacgaaactatcctatcagaacaggggaacaggaccacgttcgaaacctgccgcctccgcgcaaaagccgccgaggaagagataagtctcgaggagctatccagagtcctactcatgatcaacaagaaacggggttacaagtcttcccggaaggtgaaaaaggaagaagacggagtacttatcgacggaatggagatagcgaagaaactgtacgaggaagaccttacaccaggacagctatgctcacaactactcgagagcggaaagaaagtgctcccggacttctaccgaagcgacctgcaggaagaactcgaccggatatggagcgtacaaaagcagttccacccagacgtattctgcgacgcggcgaaggaagagataaaaggtaagaatcgctcccaaacatgggcgatcctagcaaactacttcgtctggaaggaagaagtagttgggtggaacgacagagaggccaaaaacgagaccatagaaaaagaatgcaaactggtcgggctgaagagaacaacgaaaggttacgaactcaagaaagaaaactatcgctggcgggcacaagcacttacagagcaattgggacttgaagaaatagcagtcgtcctacaggaaattaacggacaaatcaatgcatcaagcggctatctgggcgcgataagcgacagatccaaagtactatacttcaaccaccagaccgtgggccaataccaaatggcggaactcgacaaaaacccgcatgcgtcacttagaaacatggtcttctaccgtcaggattatctggacgagttcgaccggatctgggaaaagcaggcagagttccacaaggaattaacagcggaactgaagaaagaaatcagggatatgatcatcttctaccaacgacgtctgaagagtcaaaagggcctgatttcattctgcgaatttgaaaggctcgaaatcgtcgtagagaaagacggcaagaaacaaacaaaggttatcggatgcaaagtgataccacgaagccacccactcttccaggagttcaaggtctggcaaaccctcaacgacataaaagtcctaggtcgagaaaagaagcgcaacgccctttcagcatcagaatcccgagccttgtaccccgaagaaaaagagatcctggcgcgcgaactagccatcaaagagaacatgaagaaagccgatgtcctgaaactactcttcgaaaacccccaagaactagacctaaacttcaaacaaatagacggcaacagaacgggattctcactcttctcagcttacagtaaaatgatcgagaaatacggttacgaacccctggacttcaaaaagccagcggacgaaatcatcggacagctgcgaaccatattcaccgacctagggtggaacaccaacctattcaccatcgacctcaccaaggaaggaaaagaactcgagatgcaaccctacttcagactgtggcacctactctatagtttcgaaggcgacaacacgagcacgggaaacggaaagctcatagaaaagataatgcaactctgcggggtagaaaaggaatacgcggttgaactcgccagcttgagcttccaggacgactacggatcgcttagcgcaaaggcgatcaaaagaatccttccataccttaaagaagggaacctatacgatgtggcatgcgaatacgccgggtatagacactcgaaaagcagcctaacaaaggaagagatcgagaacaaagtcctcaagggaaagctcgaagtccttccgaagaacagtttacgaaacccagtagtcgagaaaatcctgagtcagatggtcaacgtaatcaacaccatcatagacacctacggcaaaccggacgaaatacgagtggaactagcgcgagagctaaagaaaagcgcaaaagagcgggaggagctgaccaaagcgatcgcaaagagtacaagagaacatgaagaaatacgcaagctcctccaggacgagttcggcatgatgaacgtaagcagaaacgacattataagatacaagctctacgaagaactgaaagacaacgggtacaagacgctatactccaaccagtacatacctaaagagaaaatcttttccaaggaaatcgacatcgaacacatcatcccacaatcccgtttatttgacgactcactctccaacaagaccctcgaatacaaagcaatcaacatcgaaaaaggtaataagaccgcatacgacttcgtcaaagaaaaatacggagaagaaggactccagcaatacataaacagatgcgaaagcctcttcaacgacaaaaaggccaagctaagaaaactgaaaatggaacagaaggacatccccgacggcttcatcgacagagatctccgcaacacacaatacatagcgaagaaagcgctagccatgctgaacgaaatatgcagaagagtcgtcgcgaccaccggctcaatcacggaccaactaagagaagactggcagctcgtcgacgtaatgaaagaactcaacctccctaaatacgaggcgctcggcttcgtcgagacctacgaggacaaagacggaagaaaaataaaacgaataaaggactggaccaagcgcaacgaccaccgccaccacgccatggacgctctaaccgtagcctttacaaaagacgctttcatccagtacttcaacaacaaaaatgcagctcaagactccggcaatcgtaaccacaccaacataataggcatcaagacacgctacttcgacaagggtagagccctgcccccgatccccctcgagcaattccggattgaagctaaacaacacctggaaaaactactcgtaagcatcaaagccaaaaacaaagtcgtgacggttaacgtcaacagaacaaagaagcgcaaaggggagaacactaaaatccagcagacaccaagaggccaattgcacctggaaaccgtatacggttcacacaagcaatacgtgaccaaaatcgaaaaggtaaacgcctccttcgacgccgcaaaaatagccacggtctcaaagcgcgcgtaccgaaacgctctgctgaagcgcctagaaaccttcggtaacgacccaaagaaagccttcacaggtaaaaacgcactggagaaaaacccactatacgcggataaataccagaccataagggttcccgaaaaggtccagaccgtcgagttcgaaaccatatataccatccgaaaaccggtggaccccgcgctcaacgtggacaaagtcgtcgacgtaaaagtccgcgccatcctggaaagacgactcaaggaatacggcggagaccccaaaaaggccttcgtcaatttctgggaaaacccaatctggctaaacaaggaaaaaggaattagcatcaagagggtcagtatccgcggcattaacaacgcacagagcatccacgtcaaaaaggacaaaaacggcaacccaatatgggacgaaaacggcaaacagatccccgttgacttcgtcaacacggggaataaccaccacgtcgccatatacagaaaacccgtcctggacaagaaaggacaagtcacattcgacgaagacggaaacctgatgtacgaactagacgaagtagtcgtaccatttttcgaggcggtaacgcgggccaacttagggctgcccatcatagacaaagactacaggaaatccgaaggatggcaattcctcttctccatgaaacaaaacgaatacttcgtgtttcccaatgagaaaaccgggttcaacccgaaagaagtcgacctcctgaaccccgacaactacgcaatgatctcaccaaacctattccgtgtccaaaccatgagtaaagtaatgtacggaaacaacgtggtaagagactacaagttccggcaccatctggagaccacggtaaaagacatgaaggagctaaaagacatagcctacaaacaatataaaacactgagctttggcaactcagtcgtcaaaataaggataaaccacatcggccagatagtcagcgtgggagaatactga

SEQ ID NO: 6811 - RNA, 4275 nt, synthetic construct
  misc_feature 1..4275: note = Cas9 variant
  source 1..4275: mol_type = other RNA
atgaaaaggatactggggctcgacctcggcaccaactccataggatgggccctcgtcaacgaagccgaaacagacgaggaagtgagctccataatacgactgggagtccgagtgaacccactcaccgtcgacgaaacacaaaacttcgaaaagggaaaaagcatcacaactaacgcggaacgcactctgaaacgaagtatgcgaagaaacctacaaagatacaagctgcgccgcgacgccctcgttgagttcctcaaagaactaggcttcatcacagacgaaactattctctccgaacaagggaaccgaaccacgtttgaaacctgtcgcctacgcgccaaagccgcggaagaggaaatcagcctggaagaactatcccgggtcctgctgatgatcaacaagaaacgcggctacaaatcgtccaggaaagtaaagaaagaagaggacggggtcctcatcgacggcatggaaatcgcgaagaaactatacgaggaggacctaaccccaggacaactatgctcccaactgctcgaaagcgggaagaaagtacttccggacttctaccactccgacctacaagaggaactagacagaatctggtctgtacagaaacaattccaccccgacgtgttctgcgatgcggcgaaggaagaaatcaaaggaaagaaccgcagtcagacatgggccatcctcgccaactacttcgtttggaaagaggaggtggtgggctggaacgaccgagaggccaaaaacgagaccatagaaaaagagtgcaaacttgtgggactgaaacgcaccactaaaggatacgaactaaagaaagaaaactaccgatggagagcccaggcactaaccgaacaactcggcctagaggaaatagcggtcgtcctgcaagagataaatggccagataaacgccagcagcggctacctcggggcgatatcggacagatcaaaagtgctatacttcaaccaccaaacagttggacaatatcagatggccgaacttgacaaaaacccccacgcctcactccggaacatggtattctaccgccaagactacctcgacgagttcgacagaatatgggaaaaacaagcggagttccacaaagaactcaccgcggaactaaagaaagaaatcagggacatgattatcttctatcagcgacgcctaaaatcgcagaaaggattgatcagcttctgcgagttcgaacgtctcgaaatagtagtcgaaaaagacggaaagaaacaaacgaaagtaataggctgcaaagtcataccacgaagccatccactcttccaagagttcaaagtctggcaaacattaaacgacattaaagtgctcggccgggagaaaaagcgaaacgcgctatcggcaagcgaaagccgagccctctacccggaagaaaaggaaatcctggcccgagaactcgcgatcaaagaaaacatgaaaaaggcagacgtactaaaactcctatttgaaaacccccaagaattagacctcaacttcaagcaaatagacggcaatcgaaccggcttcagcctattctcagcctacagtaaaatgatagaaaaatacggatacgagcccctagacttcaagaaacccgcagacgaaatcatcgggcaactcaggaccatcttcaccgacctgggctggaacacgaatcttttcaccatcgatttaacaaaagaaggaaaagagctggaaatgcaaccgtacttccgactttggcacctcctttactcattcgaaggagacaacacctccaccggcaacggcaaactcatagagaaaataatgcagctatgcggagtcgaaaaggaatacgcagtggaactcgcaagtctttcgtttcaagacgattacggatcactaagcgcgaaagcgataaaaaggatccttccctatctcaaagaagggaacctatatgacgtcgcgtgcgagtacgccggctaccgacactcaaaaagctcactaacgaaagaggaaatcgaaaacaaagttctgaaaggtaagctcgaggtcctccccaaaaacagcctacgaaacccggtagtcgagaaaatcctcagccaaatggtaaacgtaataaacacaatcatcgacacgtacggaaaaccagacgaaattcgcgtagaactagcacgcgagttgaagaagagtgcaaaggaaagagaggaactcaccaaagcaatagcgaaaagtacccgagaacatgaagaaataagaaaactcctacaggacgagttcggcatgatgaatgtaagccgcaacgacatcatacgttacaaactttatgaggaactaaaagacaacggctacaagaccctctattcaaaccaatacatcccaaaagagaaaatcttcagcaaggaaatcgacatcgaacacatcatcccccaatcccgactgttcgacgacagcctatcaaacaaaacactcgaatacaaagcgataaatatcgaaaagggaaacaagactgcgtacgacttcgtaaaagaaaaatacggcgaagagggcctacaacagtacatcaacagatgcgaatcactgttcaatgacaaaaaggcaaaactcagaaagctaaaaatggagcaaaaggacatacccgacgggttcatagacagggacttgaggaacacgcagtacatcgccaagaaagcgctcgccatgctgaacgaaatatgccgaagagtagtcgcaacaaccgggagcataacagaccagctccgcgaggactggcaactcgtcgacgtaatgaaggagcttaatctgcccaagtacgaagcccttggctttgtagaaacctacgaggataaagacggacgcaagataaagagaatcaaagactggaccaagcggaacgaccacagacaccacgcgatggacgcgctgaccgtcgccttcacgaaagatgccttcatacagtatttcaacaataaaaatgcagctcaagactcgggcaaccgtaatcacacaaacatcatagggatcaaaacccgttacttcgacaaaggcagagccctcccacccatccccctagaacaattccggattgaagcaaaacagcacctagagaagctcctagtcagtattaaagccaagaacaaggtagtgacggtaaacgtgaacagaacaaagaaaagaaaaggagaaaacacaaaaatacaacaaacgccccgcggccaactacatctcgaaacggtatacggctcccacaaacaatacgtaacaaagatcgaaaaggtcaacgcctcattcgatgcagccaagattgccaccgtcagcaaacgcgcctacaggaacgccctcctaaaacggctcgaaaccttcggaaacgaccccaagaaggcgttcactggcaagaacgcactcgagaaaaacccactatacgccgacaaataccaaaccatccgagtgcccgaaaaggtacaaacagtcgaatttgaaaccatttacacaatcaggaagccggtcgaccccgccctcaacgtagacaaagtcgtcgatgtaaaggtccgcgcaatactcgaacgccgtctcaaagaatacggaggggaccccaagaaagcgttcgtgaacttctgggaaaaccccatctggctgaacaaagaaaagggaatatcaataaaacgtgtatctatacgaggaatcaataatgcgcaaagtatccatgtcaagaaggacaaaaacggcaaccccatatgggacgagaacggaaaacaaatcccggtggacttcgtgaacacgggcaacaaccaccacgtagctatctacagaaagcctgtcctcgacaagaaagggcaagtaacatttgacgaggacggaaacctcatgtacgaactcgacgaagtcgtggtacccttctttgaagccgtgacgcgggcaaacctggggctccccatcatagacaaagactaccgcaaatcggaaggatggcaattcctattttcaatgaaacaaaatgaatatttcgtcttccccaacgagaaaaccggcttcaaccccaaggaagtagaccttctgaacccagacaactacgcgatgatatcacccaacctattcagggtacaaactatgtccaaagtcatgtacgggaacaacgtggtaagagactacaagttcagacatcacctagaaactactgtcaaagacatgaaagaacttaaagacatagcgtataagcagtacaagacattgtccttcggtaattccgttgtaaaaatccgaataaaccacatagggcagatagtctcggtgggggagtactga

SEQ ID NO: 6812 - RNA, 4278 nt, synthetic construct
  misc_feature 1..4278: note = Cas9 variant
  source 1..4278: mol_type = other RNA
atgcgccgcaacatactcggactcgatcttggcacgacgtcaatagggttcgccaaggtgatagaagacgaagactaccaaaacagcgcagtcgagctgatcggggtccgagtcaaccctttaacaaccgacgaacagacaaatttcgagaaagggcggcccgtgtcggtcaacgcagataggacactcaaaaggggcatgcgtagaaacctggaccgataccaactccgccgccaccacttgatagaagtgctcaaggccaaccacataataaccgtcgacactaagctcgcagaggacggcaaaaataccacccacgcgacctacgccgtgagggccctagccgcaacagcagaaatccccctagaagcattcgcgcgtgtattgctcgccataaacaagaaaagaggctataaaagctcccgcaaagccaaaaatgaagatgaaggacaactcatagacggcatggccgtcgccaaacgactctatgaagaaaacctcacccccggccaactcagttatcttctcctcaaggaaggcaaaaagtacctcccagacttctaccgatccgacctcaatgcagaactcgacaaagtatggtcgttccagaaacaattctatccagaaatcctcaccgaagaatttaagaagcacctggaaggaaagggacagcgcgccacatcagccgccttctggggccaatacggattcaacactgccgaaaacaaaggctcacgcgaggagaagaagctgaaagcgtaccaatggcgctccgaggcggtagatcagcaactcacgaaagaggaggtcgcctacgtaataacagaaataaacaacgacctcaacaaatcgagcggataccttggagcaatcagcgaccgatctaaggagttgttctttaacaagcagacagtaggccaatacctctaccaacaactaaagcaaaacccccacacccgactcaaagggcaagtgttctacagacaggactacctcgacgagttcgaaaccatctgggaaacccaagccaaattccaccccgaactaacggcggctctgaaagaagaaatccgggacgtgatcatattttaccagcggaaactcaagtcacagaaaggcctgatctcattctgcgagttcgaatccaaagaaatcgaagtagagaaaaatggcctaaagatcaagaaaagaatcggcctaagggtagcacccaagtcatcgcccctgttccaagagttcaagatctggcaagttctgaacaaccttgagttccggaacaaatcctctaaagaagtcttcgtaccagacatgacagctaagcaacaacttttcgacgaactgaacataaagggaaacctactcgcctccgaagccataaaaatcctcgggtacaaaacaaaagactgggaagcgaactaccacacactagaaggcaacagaacaaataagtcgctatacgatgcctacctgaagatcctcgaacttgaaggttacgacgaagacctactcaaactcagtggcagtgacgacatagacgtgagcaaaatcgaaaaatcagccagcgaaatcaaacaaatggtccacgcggtgttcgaagttcttggcataaactctacaatattggacttcgacgctgaagcggacggtaaagcattcgaacaacagaccgcctatcgactctggcacctactgtacagcgccgaagacgacaacaaaaagtacctccaagaagatatcttcatatacggacatgacaacatcgggttgaaaaagaaactatgcgaacgcttcggctttcgccccgagcacaccaaaatcctagtgaacgttgcattcagcggtgactacggctctctctcctccaaggcgatgagaaagatctacccgttcattaaggaactaacatatgacaaagcgtgccgcgaggcgggctatagacactcggcaagctcgctctccaaggaagaaatagccacacgaccgttgcagaaaaggctaggactgctaaagaaaaacgaactccgctccccggtcgtcgagaagatattaaaccaaatggtaaacgtcgtaaacgccctcatcgacgatgagaataaaaggcgaaaggcccgaggactatcggacgatttccactttgacgaaatccgcatagagctagcacgggaactcaagaaaaacgcaaaagaacgcgccgaaatgacaactaatatcaacgccgccaaacaactacatgaaaagatcatcaagatactacaaacccagttcggcgtaagcaacccatcacgcaacgatataatccgatacaaactctacgaggagcttaagaataacggctacaaagatctttacacaaacacttacatctcccccgacatcctattcagcaaacagattgacatcgatcatatcatccctcaaatgagcctcttcgacgactcattcagtaacaaaacagtcgtcttccgcaaagacaaccaagacaaaggaaacaaaacagcgtacgactacatactcggaaagtacggagagcttgcactggaagaatacataagccgaatcacgtccctattcgaactgggcaagaaaaataaagaggaaggcatcaacaaagccaaattccaaaaactgcagaaaaggctcatcgatatcggggacggcttcatcgaaaaagacctcagagaaagtcaatacatagccaagaaagcgaaaaacatgctctacgccatctgcagaagcgtagtggccaccagcggggaaatcaccgcacgcctccgtgaagactgggacctggtcaatgtaatgcaagaaattaacctcccgaaattccgcgccctcgggctcacagaaatggttgagaagaaagacggaggacaaaaagagaggataatagactggactaaacgcaatgaccaccggcaccacgccatggacgcactcacaatagcgttcacgcgacactcccacatacaatacctcaaccacctcaatgcacgcaaggacgaagcatccaaatggcaccctgtagtaagcaagatagaggagaaagaaacagatctggtctacgacgatctgggcaaccggaaaaggaggtttaaagcgcctatgccaaactttcgggaagtcgtgaaagaacaccttgaaaacgtgttaataagccacaaagccaaaaacaaggtagtaaccaaaaacaaaaacaagataaaaacagcaaaaggagagaaaatcaaaacagaactgactccgagaggccaactccacaaagaaaccatctacggtcggtaccgctattacgaatcgaaagaggaaaaagtcggaccaaaatttgacgccgaaacaatcgggatggttgtaaacccacaataccggaagctgctgctcgagcgactcacaaccaacggaaacgaccccaagaaagccttcggcggcaaaaacacactgtctaaaaatccgctatacattgacgaggcaaaacaggaactactcccagagaaaatcctactccgttggcttaacgacgactactccatccgcaaagacgtcaccccggaaaatctcaaagacgtcaaaaccatcgaaaaggtactcgacgaaggcatcaagaaaatcttacttaaaagattggtagacttcggcaacgaccccaaaaaggcgttctccgatctagacaaaaacccaatatggctcaacgaagccaaaggaataactatcaaacgagtcaccatctcaggcgtcaaaaacgcggaagcactccactacaaaaaggaccacttcggaaacgcaatcctcaacgaaaacggcaaactaataccatcatcattcgtgagcacgggcaacaaccaccacgtcgccatctaccgcgacgccgaggggaatcttcaagaacgagtagtatccctattcgacgcagttcaactcgtcaacgccggcgaagcggtaatcgaccgagaatacaacaaaggcataggctggcagttcctcttcactatgaagcaaaacgagatgttcgtattcccgaacgagaaaacaggattcgacccaaaggaaatcgacctgctaaacacagataatcgaaagctaatcagccccaacctcttcagagtccaaaagattgcctccaagaactacttcttccgacaccatctagaaacgaacgtggaagaacgaaaagaactcaaggacatagtgtataaacctcaactcggcctaaacgcaataaaggacgttgtgaaggtccggataaaccatctcggcaaaatcatctccgtcggagaatattga

SEQ ID NO: 6813 - RNA, 4281 nt, synthetic construct
  misc_feature 1..4281: note = Cas9 variant
  source 1..4281: mol_type = other RNA
atgcccagaaagaacatattgggactcgacctaggaacaaccagcatcgggttcgctaaaatcatcgaagacgacgactaccagtgcagttccgtggaactaataggagtccgagtaaacccgctaacgacggacgagcagaccaatttcgaaaaagggaaacctgtctcggtcaacgcagaccgcaccctcaaaagaggaatgaggcggaatctcgaccgataccaactacggagggactacctaattgagatactgagaacacaccacataatcaccgccgacaccaaactagctgaagatggcaaaaacacgacccacacaacctacgcactccgagcgctagcggcaacggcggagatccccttagaagccttcgtcagggtactactcgcaataaacaaaaagcggggatataaatcatcccggaaagctaagaacgaagatgaaggacaactaattgacggtatggcgatcgcacggcggctatatgaggaatcacttaccccagggcagttctcctaccagctcctcaaggaagggaaaaagtacctaccggacttctacaggtccgacctgaacactgaactcaacaaggtctggaacttccagaagcaattctaccccgaaatactaacggacgaatttaaacgccacctcgaggggaaaggacaaagagcaaccgctgtcgccttctggggtcaacatggcttctcgatggcggaaaacaagggatcgagagaagagaagaagttgcacgcctacaaatggcggagcgaggctgcccacaagcagctgaccaaagaagaggtagccttcgtgatcacagagatcaacaacgacctgaacaaaagctccggctacctcggcgccataagtgacaggagcaaagaactcttctttaacaaacagacggtaggtcagtacctccaccaacaactaaaagaaaatccacatacccgcctaaaaggacaagtattctatcgccaggactacctagacgagttcgaaacaatctgggagatgcaagctaagttctactccgcactgacactggagctgaaagaagaagtaagggacgtcgtaatcttctaccaaaggaaactcaaatcgcagatgggcctcatctcgctctgcgagttcgaaagcaaggaaatagagatcgaaaagaatggagaaaaagccaaaaagcggataggcctccgagtcgccccaaagagctcaccccttttccaagaatttaaaatttggcaggtcctaaataaccttgaatttcgcaacaaaaagaccaaagaggtcttcgtgcccgaaatggcagccaaacaacagctgttcgacgaactcaatatcaaggggaacctactagcatccgaggccataaaaatactcggatacaaaacaaaagactgggaggctaattaccacacgctggaaggaaaccgtacaaacaaatctctctacgacgcatggcttaaaatccttgaactggaaggctacgacgaaaacctgctaaaactatccggctcggacgacatcgacgtctccaaaatcgaaaagccagcgctcgaaatccgacaaatggtactcgccgtcttcgaggtcctcggtataagcggagcaatactcgacttcgacgcggaagccgatgggaaggccttcgaacaacaaccggcgtaccaactatggcacctcctatacagtgcggaggacgacggcaagaaatacagccaagaagacatcttcacctacggtcacgacaatatcgggcttaaaaagaaactgtgcgaaaaattcggcttccggcccgagcatacaaaaatactcgtaaacgtagtattctcagacgactacggaaacctcagcagtaaggcgatgaggaggatctacccgttcataaaagaactcacctatgacaaagcatgcgcagaagccggataccgccactcggcagcatccctcacgaaggaagaaatcgccgcccggcccctccaaaaccgccttgacctgctcaagaaaaacgaactacgcagtcccgtcgtagagaaaatactaaaccaaatggtcaacgtggtcaacacgctagtagacgacgaaaaccaaaaccgcaaagctcgcggactcagtgaggacttccactttgacgagataagaatcgaattagcccgggaactcaagaaaaacgcaaaagagcgtgctgaaatgacaacaaatatcaatacggccaaacaatcacacgaaaagatcatccggatactccagacagagttcggcgtaccaaatccaagccgaaacgacatcgtacgctataaactatacgaggaactcaaaaacaacggatacaaggacctgtacacaaacacgtacatatcccgagacatactatttagcaagcagatagacgtcgaccacataataccacaaatgagcctgtttgacgacagctttagcaacaaaacggtagtattccgcaaagacaaccaagacaaaggaaacaaaacagcctatgactacatactggggaagtacggcgaacaagctctggaagagtacatctcaaggatcacatccctcttcgaactcggcaagaagaacaaagaagaagggataggcaaagcgaaattccagaaactgcaaaaacgcctagttgacataggtgacggcttcatagagagagacctacgcgagtcgcagtatatagccaaaaaggcaaacaacatgctatatgcgatctgccgcagcgtcgtcagcacatctggggaaataaccgcacgactcagagaagactgggacttggtcaacgtcatgcaagaaatcaacctgcccaagttccgcgccctgggactgacagaaatggtcgagaagaaagacggagcccagaaagaaaggatcaccgactggacgaagcgcaatgaccacagacaccacgccatggacgccctagccatcgccttcacaaggcactcccatatacagtacctcaaccacctgaacgccagaaaagacgaagccaacaaatggcaccccgtagtatccaagatagaagaaaaagaaaccgtactaatatatgacgaccttggaaacagaaaacgcaaattcaaggccccaatgccaaatttccgcgaggtagtaaaagagcacctcgaaaacgttctaataagccacaaagcgaagaacaaggtagtgaccaagaacaaaaacaaaataaaaacagtgcgcggtgaaaaggtaaaaaccgaactcaccccaaggggccagcttcacaaagagaccatatatggccgttaccgctactacgagtccaaagaagagaaaatcggccccaagttcgacgcagaaatgatcgggatggtcacaaacccacaatacaagaaactgctcctcgaaagactcgcagcaaacggaaacgatcccaagaaagcattctgggggaaaaacgccctaaacaaaaaccccctctacgtagatgaggcccgccaggaactcctacccgagaaaatcctactgaggtggctcaacgacgactatagtatacggaaagacgtgacacccgaaaacctaaaagatattaaaacgatcgagaaaatcctagacaaaggtgtcaagaaaatcctactaaaaaggctagccgacttcggaaacgatcctaaaaaggctttcagcgaccttgacaagaacccaatatggcaaaacgaagccaagcgaatagccatcaagcgggtcacgatctcaggaattaaaaacgcggccccactgcaccacaagaaggaccacctcggcaacgatatcctcgacgagaaagggaaacagattccctcctctttcgtaagcacgggaaacaaccaccatgtggcaatctaccgagacgccgaaggcaacctacaggagcgagtggtctcgcttttcgacgcggtacaattagtgaacggcggggaaccggtcatcgacaaagaatacaacaagggaatcggatggcagttcctatttacgatgaagcagaatgaaatgttcgtcttcccggatgagaaaaccgggtttaacccgcgggaagtcgacctcctaagcagtggtaaccgaaaactcatcagccccaatctatttcgcgtacaaaaactcgcctcaaagaactacttcttcagacaccacctagaaacaagcgtagaagagaagaaagaactgaaaaacatagcctataagccacagcttggcctcaacgccctaagtaacatagtcaaagtacgcataaaccacatcggtgaaatagtctccgtaggggaatactga

SEQ ID NO: 6814 - RNA, 4281 nt, synthetic construct
  misc_feature 1..4281: note = Cas9 variant
  source 1..4281: mol_type = other RNA
atgaaaaacatcctcggcctcgatctcggcattacatcgatcagcttcgcgcatatcgtagaagacgagaacaaagaaaagtcggaaatcaaagaactaggcgtacgtatagttagcctgacgactgacgaacaatcagactttgagaagggcaaatcgatcacaactaacgccaacagaaccctgaagcacggcgcccgtctgaaccttgaccgctaccagcaacgacgcaagtacctcatcgacctcctccaaaaggcaaacctcatcacatcatcatcaatactcgccgagaacggcaaaaacacaacccacagcacatggcaactgagagccaaggccgtcaccgaacgcatcgagaaagaggaatttgcacgagtcctactcgccataaacaagaaaaggggctacaaatccagccgtaaagcgaaaaccgaagacgagggacaagccatagacggcatggcgatagcaaaacgactgtacgacgaaaacctaactccaggccagctgtcgctccaacttctccagcagaacaagaaactcctacccgatttctaccgatcagacctccaacgcgaatttgacctcgtatggaacttccaaaaacagttctaccctgacatacttaccgacagtttctacaaagaattacagggcaaaggaaaagacgcaacatccaaagcattctcgaagcggtatcattttgacaccgcagagaacaaaggctctaaagaatccgtacgcctacaagcctaccagtggagggcggaggcaatctccaaacagctatctaaagaagaagttgcctatgtcctcacagagattaacaacaatttaaacaatgcaagcgggtacctcggggcgatatcagacagaagcaaggagttatacttcaaccgacaaaccgtaggccagtacctctacgcgcagctgcaagaaaaccgacacaactcactcaaaaacaaggtcttttatcggcaggactacctggacgaatttgaacgaatctgggaaacacaagcgagctttcacaaggaactcaccgacgaactgaagaaacaaatcagggacgtggtaatcttctatcaacgcaaactgaagtcacagaaaggactaatctccttttgcgaatttgagagcaaagaaatagaaatcgaaaaagacggcaaaacaataaccaagaccatcggtgcgcgtgtcgtcccaaaatccagtcccctttttcaggagttcaaaatctggcagatactaaacaacgttacctgcaaacgcaaagggatacgaaagaagaaatccagtgccaaatcgacagaactcgatctttttaatgagccatcccagactatcttctcactcgatatggagtgcaaacagctcctcttcgacgaactcaacttgaaaggcgacttaaaaagtgacaaggtactaaagctgctcggatatagcccccaagaatgggaaataaactataaccaactagaagggaaccgcacacaaaaggcactctacgaggcctacctcaagatagtcgaaatggaggcgcacgacgtgaaggacatcctccaaattaaatccgcgaaagacgactggtcgctcgacgaaagcccgctgtccgcaagcgagataaaggaaaaagtcaaggatatcttccaagcactgggaatatgcaccaaaatcctgtacttcgaccccctactacccgtcaaggagttcgaaaagcaagactcgtaccaactctggcatctcctgtatagctacgaatcagacgactccacatcgggcaacgaaacgctataccgcatacttgagaagaaatacgccttcaagagggagcacgcaagaatcctcgctaacgtcgctctacaagacgattacggaagcctctccaccaaagcgatccgcaaaatctacccgaacatcaaagagaaccagtactccaaggcgtgcgaactagcagggtataaacactctaagctctccctaacaaccgaagaactggaagccagagaactcaagaacataataccccttctaaagaaaaacgccctacggaaccccgtagtagagaaaatactgaatcagatgattaacgtcgttaacgctcttatagagaaaaactcggaaagagacgcagagggcaaaatcaccaagtacttccacttcgacgagatacgcatcgaactcgcccgcgaactaaagaaaaacgcacaaaagcgatacgaaatgacacaaaacataaacaaggccaaactcgagcaccagaagataagcgaaatcctgcaaaagaaattcggcatcaaaaacccaaccaaatccgacatcattcggtacaggctttaccaagaactggaacacaacggatataaggaactgtacaccaacgcccccatagcccgcgacatgctgttctccaaaaatatcgagatagaacacattgtcccaaaagcacgcgtcttcgacgattcattcagcaacaaaaccctcactttccacagaatcaactccaacaaaggggagtacacagcgttcgattacataacatccctaaactcggaagaggaactcaaccaatatcttacacgcgtcgagaacgcctacaagacaaaaagcatctccttaaccaagtacaaaaaccttctcaaaaaggcatcagagattggcgacggcttcatcaaccgggatctaagagatacgcaatatatcgcaaagaaagcaaaagaaatcctattccaagtcacgaaaaacgtcctctcaacatccgggtcgataacagaccgactgcgagaggactggggtctagtagacgtcatgaaagagctgaacatgccgaaatatcagagcctcgggctgaccgaagtggaagaacgcaaagaaggtaacaaagtaacagtaatcaaaaactggaccaaaagaaatgaccatcgccaccacgcaatggacgccctaaccgttgccttcacgaaaccaagctacatccaatacctgaatcacctaaacgcgcgcaaagacgaaaataacaaaaattactcagtcatcctagctatcgaagaaaaagagacaatcaaggtcccaaccaataacggcaagaacaaacgggtattcatagaaccaatcccaaatttccgtcaggtcgcaaagaaacacctcgaagaaatcttcataagccacaaagccaagaacaaagtcgtcaccaaaaacgtaaataagcccgcaggaacagacaagcagcaaatcaccctgaccccgcgcggccaattgcacaaagagacaatctacggtaaataccagtactacgtaaacaaagaggagaaagtcggggtcaaattcgatgaaaggacaataaccaaggtctccaaccccctataccgcgaagcacttctaaagagactacaagcgaatgacaatgacccgaagaaggcgttcactggcaagaacgcactctctaaaaacccgatatacctcgacgaaaccaagaccaaaaccctacccgagaaagtgaacctcacatacctagaagaagatttctcgatccgaaaagatatcagtccggacaacttcaaggacctcaaatccatcgaaaaggtcatcgaccagggggtaaagagaatcctaatcaaaaggctacaagattacgacaacgaccctaaaaaggcgttcgtcgacctcgagaaaaaccccatctggctaaacaaagagaagggaatcgcaataaagcgggtcacgatcagcggcgtaagcaacgcccaacctctccacatcgggaaagaccacctcggaaaaaccaccctgaacaaagaaggcaacgagattcccgtagattacgtctccacaggtaacaaccaccatgtagcgatatacagagacaaagagggaaacctgcaggagcaaattgtctcctttttcgaagcagtcgtacgcacccagcaaggactccccatcatcgacaaaacctataagcaagaagaaggctggcaattccttttcacaatgaaacaaaacgaaatgttcgtcttcccaaacgccacaacaggtttcaacccggccgagatagacttgctagaccccaaaaataagaaactgatcagccccaacctcttccgcgtgcagaaaatagcgaccaaagactactttttccgccaccacctcgaaacaaacgtcgaaacagacaacgtactcaaaaacacgacctggaaacgagagggtctttcaggcctaaaagacatcgtgaaagtccgtatcaaccacctcggagacattgtatcaatcggagaatactga

SEQ ID NO: 6815 - RNA, 4281 nt, synthetic construct
  misc_feature 1..4281: note = Cas9 variant
  source 1..4281: mol_type = other RNA
atgaagcacatcctgggtctggatctcgggacgaacagcatcgggtgggcactaatcaagcaggacttcgaaaacaaacaaggagaaatacttggaatgggctcaagaataatcccaatgagtcaggacatactgggagacttcggaaaagggaacagcgtatcccaaacggccgagagaaccaagtacagaagtgtaaggaggctccgagaacgtttcctacttcgccgagaaaggcttcaccggatactcaacgtccttggcttcctccccgaacactacgcgtcacagatagacttcacgaaaagattcggaaagttcaaggaagaaaccgaaccgaagctcgtgtacagcaacgaaggattcatattcaaaaagagcttcgaagaaatgctgtccgatttcaaaacacaccaaccacagctcctagaggacaacaagaaaatcccctacgattggaccatctattatctgcgcaagaaagcactcagccgtaaaatcgaaaaagaagaactcgcgtggatcctactcaactttaaccaaaaacgtggctactaccaactacgaggggaagaggaggaagaaaaccccaataaactaatagaattttacagcctcaagatagtggacgtactggccgacgaacctcaaaaaggaaagtcagacatctggtactcattaatcctagaaaacggatggatatatcggcgaagctcaaagactccacttttcgactggaaagagaaaacgcgcgacttcatcgtcacgatagacctcaacgacgatggcagcgtaaagacggacaaggaaggcaacgaaaagcgcagcttcagagcccccggcgaaaacgattggaccctggtcaagaaaaagacagagcaggagatcgacagcagccggaagacagtcggaacgtacatctacgaaaccctgctcaaaaaccctaagcagaaaataaaaggaaagctagttcgcacaattgagcgaaaattctacaaaacagagcttaagcaaatactggaaaaacagaaggaatttcaccccgagctcagacaggatgacctttacagcgactgcgtacgcgaattatataagaacaacgaagcacaccaactcactctcagcaaaaaggacttcgtgcacctcttcatggaagacatcatattctaccaaaggccacttggcagccaaaagagctcaatatctaattgtaccctagagttccgcaaatacaaagacgagaacggaacagagcacacacaataccttaaggccattcccaagtccaacccatattaccaggagttccgcatctggcaatggatgtataacctaaacatatacaagaaagaagacgacacaaacgtcacgaaagacttcctaaacaccaaagccgactttgaaagcctcttcgagttcctcaacaaccgcaaagaagtcgaccaaaaagcccttctgaaacacttcaaactaaacgataaaacccaccgctggaactacgttgaagacaaaaagtacccatgcaacgaaacaaagaccatgatcctgagccgactggacaaagtagaaaacatatcggacgacttcctaacacgcgagatggaacagaagatctggcacataatctattccgtcaatgacaaagtggaatacgagaaagccctcaagagcttcgcaggaaagaataacctggaggacaactccttcttcgaagcctttaagaaattcccacccttcaagtccgaatacggagcattctcagaaaaagcaatcaagaaactcctaccattaatgcggatggggaaattctggaactacaacaacataagcgaacaaagcaagagccgaatacagaagattataaccggcgaatacgacgagaacataaaggacaaggtccgcgaaaaagcaatccacctcacaaccgaaactgacttccagggcctgcaactatggctggtccaatatattgtctacgggaggcactccgaagccgcaatgttaggcaaatggaacagtgcagacgacctggaagagtttctcaaggagttcaaacagcacagcctgcgtaacccaatagtagaacaagtaatcaccgaaacactgcgggtagtcaaagacatctggcagaaatacggaaacggtgctaaagacttcttcagagaaatccacatcgaactgggtcgggagatgaagctgccggccgaggaaagagagcgactgacgcggcagatatcagaaaatgaaaacaccaactttcgaataaaagccctgctcgccgaaatgatggacgacaacagtgtcgaaaacgtccgacccttctcccccatgcagcaagaaatactaaagatctacgaggagggcgtactaaacagcgatatagaaatagaagacgacatcctcaaaataagcaagaccgcccagcccagcagtagcgaccttaagagatacaaactctggctggagcagaagtacaagtcaccctacacgggtcaaatcatccccttaaacaaactcttcactccagagtacgagatagaacatataatcccccaatcccgatacttcgacgactcattcacgaacaaaatcatctgcgaaagtgcggtaaacaagctaaaagacaactacatcggcctagaatttatcaagaaactcggtggatcaatcgtcgaatgcggcaacgggaaatccgtcgccatacttaagcacgatgcctacgaagacttcatcaagaaacactacgcaaacaaccgaagcaaacgtaacaaactcctcctcgaagacatccccgagaaaatgatagaaagacaaatgaatgacacccgctacatcagcaaatacatcagcggcgtgctatctaacatcgtaagagtagaagatggcacagacgaaggtgtgaacagcaaaaacatagtccccggcaacggtaaaatcacgacacagctcaaacaagactggggccttaacgacgtatggaacgaccttatactaccgcgtttcgaacgcatgaaccacctgaccaactcgacagacttcacggcttggaacgaaaatcatcagaagtttctgcccaccgtaccagtcgagttctctaaaggattctcaaagaaacggatagatcaccgacaccacgcgctcgatgccttggtcatcgcctgtgcgacgaaagatcacgttaacctcctaaacaaccaatcggcgaaaagcgacaccaaacgctacgaccttaagaagaaacttatgaaatttgaaaaagtcgcctacaaccacccccaaaccggagaacggatagagcgggaagcaccaaagcaattcctcaagccatgggaaaccttcacaatagatgctaaaaaccatctcgagacaatcatagtcagcttcaaacagaacctccgagtaatcaacaaagccaccaattactatgagaaatacgtagaaaaggaaggaaccaaagtaaaggagagagtcgaacaaaaaggcaccaattgggccataagaaaaccaatgcataaagaaaccgtaagcggaaagatagacctcccccgcataaaggtacccaagggaaaaatcctaaccgccacccgcaaatccctggacaccagctttaacctcaaaacaatcggcagtatcacggacacaggcatccaaaagattctgaaaaactacttgcaatacaaagacaacaacccggagctcgcgttcagcccggagggaatagaagacatgaacaaaaatatcgagaaattcaacaacggaaaggctcaccaatcaatctccaaagtccgcgtcttcgaactcggaagtaaattccccctcggacaatcaggtaacaagaaagaaaaatacgtcgaagctgccaaaggaaccaatctcttcttcgccatataccaggacaaaaatggcaaaagaagctacgaaacaatccccttaaacgaagtaattgaacgccaaaaacagggcctaagcgtggtagacctcaaaggagtagacgacttctacctttcccccaacgacctggtctacgtcccgagcgaggatgagctagaaaacatcagcatgatcgacttcaacaagatgtcaagtgagcgcatatacaaggtcgtcagcttcaccgggaaccagatattcttcgtacgccaagacatagcgacatcagtggtaaacaaagccgaattttccactttgaacaagatggaacgcgcaatagacggcacaatgatcaaagaaacgtgtgtcaagctacaaatcgacagactgggcaacatttcaaaaatctga

SEQ ID NO: 6816 - RNA, 4281 nt, synthetic construct
  misc_feature 1..4281: note = Cas9 variant
  source 1..4281: mol_type = other RNA
atgtacaacatcggactcgacatcggaacgggaagcgtcggctggtgcctaacggatgaaaacggataccttctcaaggtcaacaggaaaggaaacaatgggaacacctatcgaaacagcgcctggggcgtacgtctcttcgaatccgccgacaccgcggcagactgccgaataaaaaggtccaccagacgacggtataaacggcgccggaccagaataatagagttacgcaaaatcatgagcgacatgatcatgccaatcgaccccaacttctacgcccgactcgacgaagcatttttatggaacgaggacaaatccgacaaagccaaggccccgttcctcctgttcaacgacaacggctacgacgacgtaaaatactatacagactaccccacaatttaccacttacgaaaacaccttctagaaaccaaggaaaaagccgatccgcgtttcatatacctagccctgcatcacatgatgaagtacagaggccactttctcttcgagggacagagctttgaggcgatcgacaacatcgaggacacattcatagaacttgagcacctagtcaacgtatatgtcaaggagaaagaggacacagataacaacgccgaaaacaacgcgctgtatcaagagatgaagaattacctagccgacaacaaagtcaaaaacaaagacaaaaaggagtacatcacggacacgttcatcaaggcagactatgacaacaagtactcaaaggaactggcagcagcggtactcggctacgagttcaatgtgggaatcatcgtcaacgacaattcactcaccgacgaagacggaaaagccctgaaagcaaagtttgccgatgcaaaatacgaagagaaggaggaaaaactaagcgacacactaggcgaacgctactacataatcgaaaccctgaagaaaatctattcctggaaagtactacacagcatattaggcgacaacaagtatctgtcctacgcgatggtggacaagtacgagaagcacagtgagcaactaaaagcactaaaatacctattccataagtacaccagccaagacgaatactccgagttcttccaccaagaaaagaacaaagaaggaaaatacatagtaaactacgcgaactatattaaaggcatcaagcgactgagcaacgaaactaacaagaaatacaacactaagcagcagttataccagtcgattatgaagatcctcggcgagcgcgcggccgatgatgaagtatataagaaaatcctggtcgaaatggaacaagaaacattcctggagaaaatcaacaacgtcgacaacagcgctatcccataccagctaaacctcatggaaatggacaagatcctaacccagcaaggagtgtactacaaagagctaagagacaataaggaactactcctaaaaatgctcacatcgaagataccctattatgtgggaccgcttaacaacaacagcaacggaaacagaaacttcgcgtggatgacaaagaaagacggcaaagagaacgaaaaagtctacccgtggaacgttaaagacgtagtcgacatagacgtgaccgccgaagacttcatcacaagaatgactaactactgcacatatctcccaaacgaaaaagtactgccaaaagaaagcctactctaccaacgctacatgttactcgaagaattatcacaaataagaatagacggaagaaaacttagcaaggaggaccgaaaagccatcataaatgacctgttcataggaaaaggcagagtgaaagtcagcgacaaagacttcaaggagtatcttaacaaagtaaactacgtcaaagtcaacggcaagggctacgacgtgaccggctaccaaagcgacgacggtttcgcctgtgcgctcagcagctacaacaagttccgacgcatactaggtcatatagacgaacagaacgaaaagatgattgaggacataatctactggataacagtattcgaagacaaggacatagtcaagcgaaagataaacaagcaatacgcggacagacttagcgcagaacagctaaagaaaatattaaaattgaaattcaagggctggggccgttattcctcaaaattgctcaacgggataaaaggcgacatgggcacaacgataatagaaatgctcgaagatgccgacgagcgattcgcttactgcgactattgccccaactttatgcaaataataaacaaagacgagaaaattaagcaaatcatcgacgacaaccgcccccggtacgacggcacaaaagacctgctcgacgtaatccaggacatgcataccagccccgccaaccgccggggcatatggcaaacgatgaaagcgatagaggagataattgagtacatgggggagaaaccacagcagatttacatcgagttcgcccgcgaagatgacccgaaggccaagaacaaacgagcagactccagaaaacgggccatcgacaaagcgttgaagaaactcaaagaggacgtagtcgacgagtacaacgagaaagtgtacaaagagctcaaacaatatgagaagcggctcgacgaggaaaaagtctacctgtacttcatgcaaaacggcaaggacctgtacttccccgataaagaactaaaccttgacgagctcgaaaaacttgagatcgaccacatcataccgtactccctcagcgacgacgactcactagacaacaaagcactcgtgcttaaaggtaacaaccaaaataaaggcaacaaaatagtcaaagaagccttcccacagttgttcagcaattcgggcacagtcaactactggaagaacctgaagaaagcgggcttgatcagcgaaaagaaatacaacaacttgcagaaaaacaatgttgacgacatactaacaaagggtttcattaaccgccagctagtcgagacccgacagatcgtgaagtcagtggccaacctcatcctagactactacaacgagcagatcgacgtaatcgaggtgaaagccagcctctcgacttcagtccgaaaaatgctcacctacgagaaaaaggacaacaacgggttctggatagaaaacaaggacaattgcatgttctataagaaccgagacatgaacgactaccaccacgcgcacgacgcgtacctagccaacatcattggcctatacatacagaaaaactacccgcgactgcaaaaagaactcaactactcgcaatatcgccgcatatggagaaaatactacgaaaacacgaaaaacaacaacggcgtaaactggttcgcaaccctcggcaagttcagttcaaacaacgaagaagcagattggtacggacaagacatcatcgcttatatgcggaagatcttctgctacagagacgtactgatctcgaagaaagtggaagaaaacaccggcgccttctacagcgaaaccaaatatccacgcgaagacaaggcaggcagtaagctcgtccccctcaaacaaggcaataacatgcgaggcgccaacaaccttaaagagctcgacgccagaaaatacgggggctacaaaggaggagaaaaagcctacttcgtcctcgtaaaatactgcatcgagaaggcgctaaagaagaaagtgaaaaaggaataccatatggagttcgtggaaatccctgtctacatcgccagaggcatcaaaaacaaagacattaacctatacgactacgtgtgcgacatcctcaatgaagcaaacaagaactcagtagcggacgtagaaatcctgcgcaataaagtcccaaaataccaaatgataattggcgaaaacggggaagagtactacctagtcagcgccacagaagtaataaattcaaagcaattcgtcctaggcggggccaaccaacaatataacagacttttgaactacatcaagtacggcaaaaacgataagtggcaatacatacaaaccgaactcctggacgagcaactcattgggctgtacaatctactgatcgccaaaatcaaagacgagtacaagggcttcagcaaagaagccgtacgaatacaagaaaacaatagcttcgacaaacttgacgtgaaagacaaaaaggagttcatcgcagaaatgataaagctagtccagccagacagtgactacccctacctcggaaaatacgccaccgggctctccaacaggatgggcaggaagacgggagaaaaagtgggaaagaaaataaccctggttgacaagtcagtcacgggattgtacgagcgacggacaaccttcgaactcgaggacgactccagcaccaagagctgctga

SEQ ID NO: 6817 - RNA, 4281 nt, synthetic construct
  misc_feature 1..4281: note = Cas9 variant
  source 1..4281: mol_type = other RNA
atgaaaaacatcctggggctagacctgggcaccaccagcatcggcttcgcgcacatagtcgaggacgaaaacaaagaaaagagcgaaattaaagagctcggggtacgtatagtaagcctaaccaccgatgagcaaagcgacttcgaaaaaggaaaatccatcaccacgaacgccaaccgaaccctaaagcacggagcgcggctcaacttggaccgataccaacaacggcgcaagtaccttatcgatctactccagaaagcaaacctaatcacaccgagttccatcctcgcagagaacgggaaaaacaccacgcacagcacgtggcaattacgcgcaaaggcagtaaccgaacgaatcgagaaagaagaattcgcgcggatactgctagccataaacaaaaagcgcggatacaaaagtagcagaaaggccaagaccgaagacgaagggcaagcaatcgatggaatggcaatcgcaaagagattatacgacgaaaacctgacccccggtcagctttccttacaactgctacaacaaaataagaaactcctccccgacttctaccggtcggacctccagaaggagttcgatcttgtctggaattttcaaaagcaattttacccagacatcctcaccgacatcttctacaaagagctccaaggcaaaggcaaagacgcaacaagcaaagcgttctccaaacgataccatttcgacaccacagagaacaaaggctcaaaagaatccgtacggctacaagcatatcagtggcgggccgaagccatatctaaacaactttcaaaagaagaggtcgcctacgtactgacagaaataaacaataacctgaacaacgcatctggttacctcggagccataagcgaccgatccaaagaactctatttcaaccggcaaacggtcggccaatacctctacgcaaaactgcaagaaaaccgacacaattccctgaaaaacaaggtattctataggcaggactacctcgacgaatttgagaggatatgggaaacgcaagcctcgttccacaaagaactaaccgacgaactgaagaaacaaatcagggacgtagtcatcttctaccaacgcaagccgaagtcccaaaagggacttatcagcttttgcgaattcgagtcaaaggaaatagagatcgagaaagacggcaagacaatcacgaagaatatcggcgcacgagtcgtcccaaaatcgtcccccctgttccaagaattcaaaatctggcagatcctaaacaacgtgatctgcaaaagaaaaggaattcgcaaaaagaagatcagcgcgaaaacaacgcaactggacctactgaacgagtccagccaaacaatattcagcctcgacatggaatgcaagcaactactcttcgacgagctcaacctcaaaggcgaccttaaatcggacaaggtcctcaaactacttgggtacagtccccaggagtgggaaatcaactacaaccaactcgaaggcaaccgcacacaaaaggcactctacgaagcatacctcaagatcgtcgagatggaggcacatgacgtcaaggacatactccaaatcaaatcggcaaaggacgactggagtctagacgaatcaccactaagcgcaagcgaaatccgagaaaaagtcaaagcaatcttccaaaccctgggaatctgcaccaagatcctatacttcgaccccctactacccgtgaaagaattcgaggagcaagacagctaccaactatggcacctcctctatagctacgagtccgacgacagcacctcaggcaacgaaacactctatcgcatcctggagaagaaatacgcgttcaagagagaacacgcacgcattctcgccaacgtagcactacaagacgactatggcagcctgtccacaaaggcaatacgcaaaatatacccgaacataaaagaaaaccaatactccaccgcatgcgaaaaagccggctacaagcactccaagctctcactcaccactgaggagctcgaagcccgcgaactgaaaaacataataccgctgctcaagaagaacgctcttagaaaccccgtcgtcgaaaagatcctcaatcaaatgatcaacgtcgtgaacgctctcatcgaaaaaaactctgaacgagatgcggaaggcaagataaccaagtacttccatttcgacgaaatccggatcgaactggcaagagagctaaagaaaaacgcccaaaaacgctacgaaatgacccaaaatatcaacaaagcaaaactagagcatcagaaaataagcgaaatcttgcagaaagaattcggcatcaagaacccaaccaaatccgacatcataaggtaccgtctataccaggagctggagcataacggttacaaagaactctacacgaatgcccccatcgccagggacatgctcttctccaaaaatatagaaatagaacacatcgtccccaaagcccgggtgttcgacgatagtttcagcaacaaaactctcaccttccaccggatcaattcagacaaaggcgaatacacagctttcgattacataacctcgctaaactcagaggaagaactgaaccaatacctcacccgagtcgagaacgcgtacaagacaaaatctatctccccaaccaagtacaaaaacctgctcaagaaggcctcggagatcggagatgacttcatcaatcgtgacctgcgtgacactcaatacatcgccaagaaagccaaggagatactattccaggtcaccaaaaacgtactgagcacaagtggctcaatcaccgacagactacgtgaagactgggggctagtcgacgtgatgaaagaactaaacatgccaaaataccagtcactaggcctcacagaggtggaagagcgcaaggacggaaacaaagtcaccgttatcaagaactggacaaagcggaacgatcaccggcaccacgccatggatgccctaactgtggccttcacgaaaccgtcctacatccagtatttaaatcacctaaacgcccgcaaagacgaaaacaacaagaattacagcgtaatcctggcgatcgaggagaaagaaactatcaaagtccccaccaacaacggaaagaacaaaagagtctttatcgaaccgatcccaaattttcgccaagtcgccaaaaagcaccttgaagaaatcttcatatcacacaaagcgaaaaacaaagtcgtaaccaagaacaccaataaaccggccggcactgacaagcaacagatcacgctaaccccccgcggccagctccacaaggaaacaatctacggcaagtatcaatactatatcaacaaagaggaaaaaataggtgtaaaattcgacgagcgaacaatcgccaaagtcagcaaccccgtatatcgagaagcacttcttaagaggctccaagccaacgacaatgaccccaaaaaggccttcgccggaaaaaacgcgctctcgaagaaccccatatacctcgacgagagtaaaaccaaaaccctaccggaaaaagtgaatctaacgtatttagaagaagacttctccatccgcaaagacatcagtccagacaacttcaaagatctaaagagcattgaaaaggtaatcgaccagggcgtcaagcgaattctgattaaaagacttcaagcctacgataacgacccgaagaaagccttcgtcgacctcgaaaaaaaccccatatggctcaacaaagaaaagggaatcgcgattaaacgagtcaccatatccggtgttaacaacgcgcaaccgctgcatatcggcaaagaccacctcggaaaaacaaccctgaacaaagaggggaaagagatacccgtggactatgtctcgaccggaaataaccaccacgtggccatctaccgcgacaaagaagggaacctgcaagaacagatcgtgagcttcttcgacgcagtagtacgcgcccaacagggcatacccataattgacaagacatacaaacaagccgagggttggcaatttctcttcacgatgaagcaaaatgaaatgttcgtcttccctaacgcaaccaccggcttcaacccagccgaaatcgacctactggatccaaagaacaaaaaactaatatccccgaacttattccgtgtacaaaaaatcgccaccaaagactactttttccgacaccacctggaaacgaacgttgaaacagataatatattaaaaaacgtgacctggaaacgtgaaggcctatccggcctaaaagacatagtaaaagtacgcataaaccacctgggcgacatagtcagtataggcgaatattga

SEQ ID NO: 6818 - RNA, 4281 nt, synthetic construct
  misc_feature 1..4281: note = Cas9 variant
  source 1..4281: mol_type = other RNA
atgaaaaacattctcggcttagacctcggaaccacaagcatcggctttacacacatcgtagaagacgagaacaaggaaaagtcggaaatcaaggaactgggagtgagaatcgtatccctcaccactgatgaacaatccgacttcgagaaagggaaatccatctcaacgaacgccaaccgcacactcaaacacggggcccgcctcaatcttgaccggtatcaacagcgacgcaagttcctcatcgacctcctccagaaagctaaccttataacaagctcctcgatactggcggaaaacggcaaaaacacgacccactccacatggcaactccgtgctaaggcagttacggagcgaatagagaaggaagagttcgccagagtgctactcgccataaacaagaaacgaggatacaaatcaagcagaaaagcgaaaaccgaggacgaaggacaggccatcgacggaatggcgatagccaaacgcctatacgacgagaacctcacacccggacagctcagtctgcagctgctccaacagaacaaaaagctactgcccgatttctaccgctccgatctccagaaggaatttgacttagtgtggaacttccaaaaacaattctaccccgacatactcacagactcgttctacaaagagttgcaaggcaaaggtaaagacgcgacctcaaaggccttcagcaagcgctaccacttcgataccgccgagaacaaaggaagcagggaaagcgtacgcctacaagcgtaccagtggcgcgctgaagcaatatcaaaacaactctcaaaggaggaggtagcctacgtcctcacagaaatcaacaacaacctaaacaacgcttccggctatctgggagctatcagcgaccgctcaaaagaactctacttcaaccgtcaaaccgttggccagtacctatacgcccagctacaagaaaataaacacaacagtctgaagaacaaagtcttttaccggcaagactatctcgacgagttcgaaaggatctgggaaacacaagcatcattccataaagaactgacggaggaactcaagaaacaaatcagggacgtcgtcatcttctaccaacgcaaattaaaaagccaaaagggccttatatcattctgcgagttcgaatccaaagaaatcgaaatcgaaaaagacggcaagaccatcaccaagagcataggcgcaagggtagtcccaaaaagttcccctctattccaggagttcaagatctggcagatactcaacaacgtgacttgcaagcgcaaaggaatccggaaaaagaaatccagcgccaaatcaaccgaactcgacctcttcaacgaaccaagccaaacaatattcagcctggacatggaatgcaagcaacttctgttcgaagaactcaatttaaaaggtgatctcaaaagtgacaaggtgctaaaactcctcggctactccccgcaggaatgggaaataaactacaaccagctcgaaggtaaccggacccaaaaagccctgtacgaggcgtacctcaaaatcgtagaaatggaagcccacgacgttaaagacatcctacaaatcaaatccaccaaggatgactgggccctggaagagagcccgctctccgccagcgaaatacgagaacgggtcaaagctattttccagaccttggggatctgtacaaaaatactgtacttcgaccccctgttacccgtcaaagagttcgaggaacaagacagctaccaattatggcacctcctctatagctacgaatccgacgacagcacgtccggcaacgaaaccctctaccgcatactcgaaaagaaatacgcattcaaacgcgaacacgccacaatcctcgcgaacgtcaccctccaggacgattacggcagcctcagcaccaaagctattcggaaaatctacccctacataaaagaaaaccagtattccacagcctgcgaaaaagctggatacaaacatagcaaactatctctcacgacagaggaactagaggcccgcgaactcaagaacatcattccccttctgaagaagaacgccttgcgaaaccccgtcgtagagaaaatcctcaaccaaatgatcaacgtcgtcaatgccctaatcgagaaaaacagtgaaagggacgctgagggaaaaatcacgaaatacttccacttcgacgaaatccggatagaacttgcaagagagcttaagaaaaacgcccaggaacgatacgagatgacgcagaacataaataaagctaaactagaacaccagaagatctccgggatactccagaaggagttcggcattaaaaacccaaccaaatcagacataacacgctaccgactataccaggaactagcacacaacggctacaacgacctatacacaaatacttacatacccaaagaactcctattctccaaaaacatagacatagaacacatcgtctcgaaagcacgcgttttcgatgattccttctcgaataaaacactcgccttcagagaatttaacatcaagaaaggagagtcaacagcattcgattatatcacctcgctaaacaacgaagaggaactaaatcaatacctgaacagagtcgagaacgcctataaaactaaaaacatctcacccgcgaaatacaaaaacttactgaagaaagcctcggagatcggggacggcttcatcaatagggacctccgcgacacacaatacatcgcgaagaaagccaaagagattctcttccaagtaacgaaaaatgtactcagcaccagcggaagcatcaccgaccgccttcgtgaggattggggccttgtcgatgtaatgaaagaactaaacatgccaaaataccagagcctaggcctcaccgaggtggaagaaagaaaggaggggaacaaagtaacagtcatcaaaaactggaccaaaagaaatgaccaccgccaccacgccatggacgccctgactgtcgcgttcacaaaaccctcctacatccaatacctcaaccacctaaacgccagaaaagacaaaaataacaagaactactccgtaatccttgccatcgaggaaaaagagacaatcaaagtaccaaccaataacggcaaaaataagcgagtcttcatcgaaccaattcccaacttccgtcaggtcgccaaaaagcacctcgaagaaattttcataagccacaaagccaaaaataaagtggtcactaagaataccaacaaacccgcaggcaccgacaagcagcaaatcaccctcaccccacgaggacaactacacaaggaaaccgtttacgggaaataccaatactatgtaaataaagaagagaaaatcggcgtcaagttcgacaaggaaacaatcgccaaagtctcgaaccccgtttaccgggaagccctactaaagcgcctgcaggccaacgacaacgaccccaagaaagccttcgcaggcaaaaacgccctcagcaaaaacccaatctacctcgacgaagcgaagacaaaaaccctgacggaaaaggtaaacctgacctacctcgaagaagacttctcaatacgaaaagatatcagccccgacaatttcaaggacctaaagtccatagaaaaggtaatagaccagggagtcaaaagaatcctcattaagcgcttacaagactacgacaacgacccaaagaaggcattcgtcgacctggaaaagaacccgatatggttaaacaaggaaaaagggatcgccatcaagagagtaaccatcagcggcgtgaacaacgcgcaaccactccatatcggaaaggaccacctggggaagactaccctcaacaaggaaggtaaagaaatcccagtcgattacgtctctacgggtaacaaccaccacgtcgccatctaccgcgacaaagaaggcaaccttcaagagcagatagtgagcttcttcgaggcagtagtcggcgcccaacagggcctcccaatcgtcgacaagacttacaaacaggcggagggctggcaattcttgttcaccatgaagcagaacgaaatgttcgtcttccccaacgaagcgacaggattcaaccccgcagaaatagatctgctagaccccaagaacaaaaagcagatctccccaaacctattccgggtacagaaaatcgcaactaaagactacttcttccgccaccacctcgaaacgaatgttgacacagataacgtactcaaaaacaccacatggaagcgcgaaggtcttagcggcttaaaagacatcgtaaaagttcgcatcaatcacctaggcgacatcgtaagtatcggagaatactga

SEQ ID NO: 6819 - RNA, 4284 nt, synthetic construct
  misc_feature 1..4284: note = Cas9 variant
  source 1..4284: mol_type = other RNA
atgaagaaaattctaggcctggatctcggaacctcatcaatcggatgggccctagtcaacgaggcagagacctcagaggagaagtcaagcatcatcaaacttggagtgagggtcaaccccctcacagtcgacgaactacaaaacttcgagaaaggcaaaagcatcaccaccaacgccgacagaaccgctggcagatctatgcgaagaaacctgcaaaggtacaagctccgtagagaaaacctaatagaagtcctgaaagagtacaacttcataaccgacgagatgatattatccgaaaatggaaatcgcaccacgtttgagacctaccgactcagggcgaaggccgccgtagaggaaatatcgcttgaacagttcgcccgagttctcctcatgatcaacaaaaagagaggatacaagtcatcccgcaaagcaaaaggggcggagaacggcaccctcatcgacggcatggaagtcgccaagaaaatgtatgacgaaggcatcactcccggcgaactctgcctacaactactgacagccggcaaacggtacttccccgacttctaccgaagcgacctccaagccgagttcgacaggatttggaacttccagaaacaattctatcccgatagcctgatcgacaaagtaaaagacgaagtcagggggaagaacaaatcacaaacatgggcaatcctcgcgaagtatttcgtctggaaagaagtagaaaactcttggaacgaagaagaagcacaaacgcgccgagtcgaaaaggagtacagacttgtcggcatcaaacgaggagtcaaaagagaggaactcaaattggagaacttccagtggcgagtaaaggcgctctcggaacgaatgaaccccgaggagctggccatcgtcctacaggaaataaacgagcagatctcaaacagctcaggctacctgggagccatcagcgaccgaagcaaagaactctacttcaaccgccaaacggtcggccaatatcaaatggccgtacttgataacaaccccaacatagggctccgcaacatggtcttctatcgccaagactacctagacgagtttaacaccatatgggaaaaacaagcagagttccacaaagaactcacggaagacctgaagaaggagatacgggacatagtgatattctaccagaggcgcctaaagagccaaaaaggcttaatcaacatctgcgagttcgaaagaagacaaatagaagtggaaatagacggaaagaagaaaatcaaaactataggctcccgagtcatccccaggtcgagtccgttgttccaggagttcaaaatctggcagacgctcaacgacatagaagtcagcgtcctcggcgtcaaaaacaaacgcaagaagcaagatgacaacagcacaacgctactcgactccgccgaaaacatagacagtctcaaactaaatgtctcgcgcccgctagacgcggacgaaaaatcactcctagcaaaggagctgtttatcagggacaagctaacaaagtcagatgtactaaaacttctgttcaataatccacaaaacctcaacctaaactttaaaaacatcgatggcaaccgaacggggagcgccctgtaccaggcgttcagcaaaatcctcgaaatttcgggacacgaaagcataaacttcaaaaagagcgccgacgagatcgtcgagcaggtaaaaacaatcttctcagccttaggatggaacacagaggtcctctgttttgactcagaaaaagagctagacaaacaaccatacttcaaactgtggcatctcctttacagcttcgaaggtgactccacacccacgggggacggaaacctcatccaaaagatcgcggacctgtgcggctttgaaaaagactacgcgagcatcttagcgaacattaccttccaggaggactacgggtcgctttcgaccaaggccatccgaaaaatcctccctcacttgaaagacggaaaccagtacgacgtcgcctgcgagtacgcaggatacaaacacagcaagtcctcgctgaaaaaggaagagatcaaaaataaagtcctcaaggacaagttagagctcctcccaaagaacagcctacggaacccggtcgtcgagaagatcttgaatcaaatggtaaatgtcatcaacgccatcatcacgacctacggcaagccagacgaaatacgcatcgagctcgcaagggaactgaaaaagaacgcaaaggaacgagaagaactaaccaaatccatcgtcgacaccacaaagacccacgaagggatcagagcaatcctacaaaacgacttcggcatgtcacacgtctcgcgcaacgccattattcggtacaaactatacgaagaactaaaagacaacggatacaagaccctgtactccaacacgtatatacctaaagaaaaactcttctcgaaagactttgacatcgaacacataatcccacaagctcgcctgttcgacgactccttctccaataagacgttagaagtgaaaagtatcaacatagagaaaggtagtaaaaccgcgtatgacttcgtcgaagaaaagtacggcgaacaaggactgcaagagtacctgaaccgctgcgaagtgctattccgcgacaagaagacaaagctccgcaaacttaaaatgcaggagagcgaaatacccgaagggttcatcgaccgggacctccggaacacgcaatacatcgccaagaaggcactctctatgctaaacgaaatttgcaggcgcgtcgtcgcgacaacaggggctatcaccgacgaactaagggaagattggcaattggtggatgtaatgaaagaactgaattgggaaaaatacaaggtactcggtctcgtagaatacttcgaagacaacgacggccgattaatcggacgaataaaggactggacgaaaagaaacgaccaccgacaccacgcaatggacgccctcaccgtcgcattcaccaaggacgtctttatacagtatttcaataacaaaaacgcctcactcaagccagacacaaatgaagcggcaatccgcaataaatacttccagaacggaaaagccatcccaccaatgagcctagacgagttccgggccgaagccaagaaacacctcaacgacacacttatctccatcaaaaccaaaaacaaagtcgttacaatcaatctaaaccgaacaaagaagaaaaacggcataaacaagaaacaacaacaaaccccgagaggccaactacacctggagacagtatacggcagccacaaacaatacgtggtcaaagaggagaaagtcaacgccagcttcgacgcggcgaagatagccacagtcaacaaaccagcctaccgcgacgcgctactgcggcgactacaagaaaacgggaacgactcaaagaaagcatttacaggcaaaaactccctagacaagcagcccgtgtggctggacgcaaaacaaaacgagtgtgtacccgaaaaagtaaagaccgtaatgctagaaaccgtatacacagtaaggaagcccatcgacgaaaagctgaacgtagacaaggtcgtagacgccagaatacggaaactactacaagaccggataaaagagtatggcaacgccaaaagcgccttcgcaaacctcgacgagaaccccatctggctcaacaaggaaaagggtataacgataaagcgcgtcagcgtctccggaataagcaaagcacaatccctccacgagaagaaggacaaagacggtaacttcattctagacaaagacagccgtcgcatccccgtggacttcgtaaatacagggaacaaccaccacgtcgcaatctatcgcaaacccgtgctagataagaagggacaggccgtgttcgacgagaacggagaactaaagttcgaactggaagaagtggtggtctcctttttcgacgcggtaacgagggttaacctgtcacaacccataatagacaaggattacaaacgcagcgaaggctggaaattcctattttccatgaaacaaaacgagtacttcgtcttcccaaacgaaaagaccggattcgaccccaaagaaatcgatctcctgaatcccgagaactacgcgctaatctcccccaatctattcagagtacagaaaatcgcgtccaaagactacgtgttccgacatcacctagagacagtcgtagccgacagaaaagagctccaagaaatcacgtggaagcgaatcagctcactgtccatcctgaaccgcataataaaggtacgagtaaaccacatcgggcaaatagtgatgatcggagaatattga

SEQ ID NO: 6820 - RNA, 4284 nt, synthetic construct
  misc_feature 1..4284: note = Cas9 variant
  source 1..4284: mol_type = other RNA
atggccaaaccaaaggactacaccattggactcgacatcggaactaacagcgtggggtgggtcgtgacagacgaccaaaacaatatattaagaatcaaaggaaagaaagcaatcggcgctagactcttcgcagaaggcaaagttgccgccgaaagacgaagttttaggacgacccgccggagactaagccgacgacgctggcgtattaaactcctagaagaactgttcgataaagaaatagccaaagtagatcccagcttcttcgccagactgcacgaatcgtggatatccccaaaagacaaaaggaaaaggtactcagccattgtattcccgtcgccagaagaagacaagaaattccacgaaagctatcctaccatctaccacctaagggacaaactcatgaaagatgaccagaaacacgacatccgcgagatatatatagctgtccaccaaatgatcaaggcccgcgggaacttcctacatgacgaaagcgtggaaacctaccgctcgggaatgtcctccctcggcggacgctcggaacgcacgatcttgtcggtgcagacgctggaagaattaaacgacctgtttgctgaaaatgagggcaccgaggaggccaagctcaacgtcgcctcagctgagcagattaacgacatcctcacgggagggcaccttaacgcagactcgcagaaagaaatcggcaacctgctactacccagctcgttcccctcgttcgatgacaaagcgaaggaaaagcaagtcaagaaactgatcaaaaacgtagctacaaacattagcaaagcctggctcggatacaaagcggacttcagtacgatactaaacctggctaacgtggacaaggaccaaaagaaaatcttcgccttcgccctacaaggaggcgatgaggaagacaaagtccaagaactcgaatccctcctggaacaaagtcaaacagacatagtagaccgattaatcgaaatccgacacgcgatcgtcttaagcgagatcgtgcccgtcggcatgacgctcagcgaggctatgattgacaagtacgaccagcacaaggaagaccttattaccctgaaagcagtaatacgaaatacaaaagacaaaaagaaagccgccaaattacaagcgatctatgacctttacgtaaacaaccgtcacgcggatcttgccaaagccatgaagctaactggtatcaagaaacgatcagaactgctggaccccgaagaactaaagaaagcaatcagcagtttactagacgactccccagaagccgtcgaaatcaaacagatgttagaggagaagacattccttccgctacaacggtcgaacaataacggggtcatccccaaccaactgcaccaggtggaacttgacgagatcattaaaaagcaaagcaagtactaccccttcctcgccgaaaagaaccctgacgaatcggaagaggcacagaaaaaggcgccaacaaagttggacgccttgcttacattccgagtcccgtactacgtaggacccatgataacgaaggaggaacaagaagcccaagacggccactcgttcgcatggatggtaaggcgcgacccacaagaccacgaggccataacaccctggaacttcgaaaagaaagtggacaaaatggcaagcgccacccaattcatcaaacgaatgaccaccaaagacacctatctgctcggcgaagacgtcctccccgctagctcactaaaataccagttattcaccgtcctcaacgagctcaataatctacgggtcaatggaaagaagttaaccagcgatgaaaaagaacaagtaatcgaggggctattcaagaaacagaaaacggtcaaagccgacaaattcgtcaagtactggcaagcaaagcacataggcgcagacatcaaagtaaagggcctatccgacccaagcaagttcaacagcaccatgtccacctacatagacttcaagaaaatattcggcgaccagctcaacgacgtcaatcgccaaaacgacttcgagaaaattatagaatattcaacgatattcgaagaccgcaaaattctagaagacaaactacgggcggacttcgcctggctatcagaagaacaaatcaaacagctctgccgcctccgccttcaaggctggggccgtctcagcgacaaactactcacgcgcctcacagacgcggacggacagaacgtacttgaacggctgtggaactctaacgacaacttcgtacaaatcgtatcagaccccaacatcaaggccaagatcgagcaggagaaccaaaagctgctacgcgacggacaaagcgacgacgccgtggaatcgatcctggatgacgcctacacctcgccccaaaacaaaaaggcgatacgccaagtaatgcgagtggtccacgacatcgtaaaggcctgcgacggaaacgtaccggctaaatttgcgatagagttcgcccgatcccaagaagacgaccccaagcgcacaacagccagagtcaaccagatgcagaaaatttacgaccaaatctccgacgaagtcgtcagccaaggcgtcaaagaacaactcagcggaatgaaatccctcaaagaccggtactacctatacttcatgcaaggcgggcgagacgcttacaccggggcaaaactcaacatcgacaggttgtccgactacgatatcgaccacatcatgccccaatctttcgtaaaggatgacagtctggacaaccgggtattagtagcacgcgccgtaaacaaccagaaaagcgacaaagtccccgcactactatttggcaacaaagtggtagcagatcttggcataacggtccgcgaaatgtgggacaagtggcaaaaactcggaatgatcagcaaacgaaagctatcaaacctcctcaccgacccggatgccctaactgaatacagggcccaaggctttattcgcagacagctagtagagaccagccaagtgatcaaactaactgcgaccatactccaaagcgagttccccgactcgaagatcatcgaagttccagctaaatacaacagcattgtgcgaaagcaattcgacctctataagtcccgcgaagttaacgactaccaccatgcaatagacgcctacctctcgacaatagtcggaaactacctctaccaagtatacccgaacctgcggcgcatgttcgtgtacggtgagttcaaaaagttcagctcgaacgctgaagaatccgcctacgacgtagtacgacgagttaagtcaatgaacttcctcgatgacctactacgggggacacacggcgacaacatctactgcagaagtaccggagaaatcgtattcaaccgaaacgacatcatctcaaaactaaagcaagcctactccttcaaacaaatgctcgttacacaagaggtcttcaccaaaaagtctgccctcttcgaccaaacagtttacccatcccccgagagggactccaagaaaagatccgggctcataccccgcaagaaaggaatggacaccgagatatatggcggatattccggaaacaaagacgcctacttcgtcctcgccgaagccgtaaaagaaaaagggcacaccctccagattgtgggagtaccgatccgggccctcaacacactgaaaaacagcgcgaactacagcgaaaaacttctagaaatcataaaaccgcaagtaatgttcaacaaagatacgggcaaacccatcaaaggcatcaaggatgtcaagatactcatggataaaataccatgcagacaaccggtactcgaaggcgagtcctattacatgctcgcctcatcaaaataccgctacagcctcaaacaaatatcgctaagccaaatgtcgatgaaatacatactagactacatcgacgacccgaatttcaacaaacacgaaatgataaacatcgaccaacaggacgagaaagaatgccttctcagcgtatacgacgaaatcctcgagaaaatggacaaatacctaccacttttcgatatccgcagcttccgaaagaaactccacgacggacgcgacgcattcatagcactccccgtggcatctgaagagaaaaagccaggaaaagtagacgtcatccgcaaagtactaaaggggcttcacgcaaacgccgatatcactaacctggccgaactaggattcggcaccgcagcactgggcgcactcgtatccacgggagggatcaaaatttccgatgacgcagtattcatctaccaatcaccaactgggctgttcgaacggcgagtcaaggtctccgacctactaaaatga

SEQ ID NO: 6821 - RNA, 4287 nt, synthetic construct
  misc_feature 1..4287: note = Cas9 variant
  source 1..4287: mol_type = other RNA
atgaagaaaatcttgggcctcgatcttggaacgacatcaatcggatcagcctacgtgctggaagccgaaaaatctgcagaacagaccaaaatagtctacctcggcacacgcatcatactcagctcagcggacgcagaaaacttctccaaaggactaagctgcagcccaacaacagatcgcacctttaagcgatccatgcgacggcgactacagcgctacaagcagcgacgaagctcattaatacaacaattcaagaagatcggaataataacaaacaccgaacaaatcatacgagaaccaatatcggagacccacgagctcctccggatcaggagcaaagcagttagcgagcgagtaagcctcgaagagttcgcacgaatactcctaacaattaacaaaagacgcggatacaagagcaaccggaagacgtccaagtccactgaagaagacggcaagctcgtggatgcgatggccgtaaccaaagaactcatcaaactgaagaaaacccctggtcaatacatgttcgagcgcttcaaacgcggcaaatacgccgaaatcgacttctatccattcgacttaatcaacgaactcaaacaaatctgggaagtccaagggcaaaaatacccagatgtcctgaccgaagacttactaagctcgctactaaagcagaaaaccggcaaagccaaagagctgatatacagcaaaagcgacctgaaccccgcagaggttcctatagactaccaaaagggcaagaaactccgcaaaaccatcctcaacaaatatttcgcgtacgagagccgttccctcgccgcgaccaacataatccccgtcgaacaagtgatcacagccatcgtggcaatctgcaaacaaattaacaacagctccggatacctcggcgcgatcggcgaccgctctcgcgtcctctacgcaaacaatcaaacaatcgggcaatacctatacgagcggatcaaagcaaacccccacgatcgtatccgcggagaagtattttaccggcaagactacctcgacgagttcgaccggatatgggaatgccaacaaaactactaccccgccatactcacaaacgaccgaaaacaattcattcgtaacagaatcatcttctaccagcgcccactcaaatccaagaaatctgaactcgccttctgcgagttcgaatcacgagaagtggaacacaacgggaaaaagtacacggaaggactccatgtagcccccaagagcagcccggtattccaacacttccgtctgtggcagcgcctgggtcaaatcgaagtctcacccctcagaaagtggaacaaacaatccaatgaactgtttgagcaacagaacgacaccgaccaggaaagaatactcaacaccgaagccaagcagaaactattctcctatctgaacttgctagatcacttgacggacaacgaaatactcaacatcctagggtactcgccggacaaatggaaaatcaacttccgggagataataggtaaccgaaccaacaacagcatgatgaaagccttcttcaacatgaaggaaatgactgacggcgaacagatcaattgggagaaaaacctaaccaaaatcacgaacggccaatcactaataagccccgaacagatagtagacttaattcgacaatttttcgaacgagaaggaatcacaaccagcctactatacttcgaccctactaccgacaacttccgcgaacaatcgcactattccctctggcacctactatattcctacgaggacgacaactcaccgacaggtacaaccagcctctgcaagacactagccaaacgctacggcatcccccacgaactctgcccactactagccagcttaactttcgaaccccaatacggttcgttaagtacaaaggctatgcgaaagatcctacccttcatgcaagaaaacggctacgacaaagcctgcgaactcgcaggttatcgccactccgcgtggaccacgaaggaagagaacaccgaacgcacgttaaagaactccctccccctcctgcgaaagggatcactacgcaaccccgtagtagagaaaatcctcaaccaaatgacacacgtaataaatacccacatcagtgaatatggaaaccccgacgaaatacgtatcgaaatggcccgagacatgcaagcaaacagcaagcaacgaaaagcaatgacgactgccatagcagaggctactaagcgaaacactcaattcatcgaggagatacaaaaagagttcgggtttaatccatccaaaaacgacctcataaagtacaagctgtggaaggaactagctcccctagggagcaaaaccctatacagcaacacctacattccgaaagaggaactcttcactgccaaattcgaaatcgagcatataataccccgtgccctgttttacgacgacagcttcagcaacaagactctagaactcaacagcgtaaacaagctcaagggcaacaaaacagcgctagactacatggacactctctcccaagaacaggccaacgactacatcatacgcgtagaggaacttaagaaaataggcgccatcacccaagcgaaatacaaaaagctactaatcagagagaaggacctgggcgacgacttcacaaacagagacctaaccaatacccgctatatcatacgacacgcagcagacatgcttctacaagtcaccccatcaatagttcacacaaacggttcgatcactgccatactaagacgagactgggaactacttgatatacttaaagaactgaatctgcccacatatgagtcgattgaccgcaaaatctccgaccccaaagaaaaactaacggagagtgtggaaagaaaggacggccaagccatcaagatgataaaggactggtccaaacgcgacgaccatcgccatcacgctatggacgccttgataaccgcactcaccactcgaaagcatgtccaatacctcaatggaaaccgaggagccgaagagaccgataaggttcagaagctccaacaactaaaggccctgcgaaaacagctcattggctcagacgggcatttcatacccccaatgcacgacataagagtacaagccaaggaggcgctctccagggtaatcattagcacaaaagcaaagggcaaagtgactacgcccaataccaacataatttgctcgcgagacaagactactggccgaaaaatatacgtcaaacaaacaaccctcacgccaagaggcgccctgcacaaagaaatgcaatacggttgcaaccattactacctagaaaaacaaatacccatcggctccaaactaacagaagaagagatccgcctcgtgtcttcgccaaaaatccggtccatgctgagcgaacgcttacaagcgtacaacaacgacccaaaaagcgccttcaccggccggaactccatggacaagaagccactcgaagacaaaaacaaaaagctagtctacacggacaagaaagtcaaacaaaccatccttgcaaaccgattcgtcaagcgcgaccgagttaactccaaactggacctagacaaagtgatcgatacaggcataaagcgaatcctcgaaagacgcctcaaacaatacggcggaaaatacgagacggccttttccgacctagaaaataacccaatctggctaaacgaagaaaaaggcatcgcgataaagtccgtaagaatccgcggcaaaaacaacacaatcacaatacggcaaacgaacacttgccggataaagtacgttgccaacgacaacaaccaccacctcgccgtgtacgccctccccgacggatccatagaagacgacattgtcagcttcttcgacgcagtcgaacgcagccgcaaaggcctccccataatcgacaagcataaaaaccaatcactcggatggaaattccttttctctgtaaagcaaaacgaatacttcctactcccccagcagggcgagaaaatagacatagacactggcgaaattagtatgcagacaactttctcacccaaggatctctcccccgaatacataatgaatccagacaactacgccgagctcgcaccccacatattccgcgtccagagcatatccaaaactccccaaggaaaccgagacgtaagaatctacctttttaagcaacaatacataagcgggtcccaaaaagactcactccatcttaagggaatcacccaccgacaaatctcaagcgccaaagacctcgccggtctggtcaagatccgcgtgaaccatctggggcgtatcgtagccgtcggggagaaatga

SEQ ID NO: 6822 - RNA, 4287 nt, synthetic construct
  misc_feature 1..4287: note = Cas9 variant
  source 1..4287: mol_type = other RNA
atgaagaaaatcttaggcctcgatctgggcacagcctcaattggcagcgcctatgtcctagaggccgaaaaatcagcggaccaaaccaaaatagtatatctagggacccgcataatcctttcctccgcggacgcggaaaatttttccaagggactatcctgctccccgaccactgaccgcacctttaagagatctatgcgccgccgcctacaacgttacaaacaacgacgtagttcccttattcaacagttcaagaaaataggcataataaccaacacggaacaaatcattcgagaaccaatctccgaaacccacgaactcctccggatcaggtcgaaagccgtatcagagcgcgtctcgctggaggagttcgcccgcatactcctcaccatcaataagcgccgcggctataagtctaatcgcaaaacaagtaaatccacagaagaagacggaaaactcgtggacgcaatggccgtcacaaaggaactcatcaaactgaagaagaccccggggcaatacatgttcgaacgattcaaacgcggcaaatacgcagaaattgacttctaccccttcgacctcatcaacgaacttaaacagatctgggaggtccaaggacaaaaataccccgacgtactgacggaagacctcctctcaagcctcctcaagcagaaaacaggaaaagcaaaagaactcatctacagtaagtcagatctcaatcccgcggaggtaccgatcgattatcaaaaaggaaagaaacttcggaagacgatacttaacaagtacttcgcatacgagtccagatcactcgccgtcaccaacattatcccggtcgaacaagcaatcaccgccatagtagccatatgcaagcaaatcaataattcatcaggatacctcggagcaatcggcgacagatcccgagtattatacgctaacaaccaaaccatcggtcaatacctctacgagcgaatcaaggccaacccgcacgacaggatccgcggagaagtattttaccgtcaagactacctcgacgagttcgatcgcatctgggaatgccaacaaaattactaccccgccatccttactaacgaccgcaagcaatatatccgcaaccgcatcatcttctaccaacgccccctcaagagcaagaagagtgaactcgccttctgcgagttcgaaagccgcgaagttgagcacaacggcaaaaagtacaccgaaggcctacatgtcgcaccaaaatcatccccggtctttcagcacttcaggctctggcaacgcctcggccaaatagaagtctccccattacgcaaatgggacaaacaaagcaacgagttatttgaacagcaaaacaacgcagatcgcgaaggcattctcaacacagaagccaaacagaaactcttcagctacctcaacctcttagatcacctgacggacaatgaaatactgaacatcttggggtactccccggacaaatggaagataaacttccgagaaatcatagggaaccgcactaacaacctcatgatgaaagcattcttctcaatgaaagagatgaccgacggagaacaaatcgactgggaaaagaaccttaccaagattacaaacggtcagtcactcatcagtcctgagcagatcgtcgacctaatccgacaatttttcgaacgagaaggaataacaacatccctcctatacttcgacccggccacagataactttcgagaacaatcccactactccctatggcatttactctactcatacgaagacgataattccccaaccgggaccacctcactttgcaaaaccctcgcgaagcgctacggtatcccgcacgagctatgccccctcctcgccagtctaaccttcgaacgccagtacggctccctatccacaaaagcgatgaggaaactccttccgttcatgcaagagaaacgctatgacgaagcctgcgaattggctggctaccgacactccgcgtggataactaaagaggagaacgccaaacgaacgctcaagaacaaactacccctccttcgaaaaggcagcctacgaaaccccgtcgtcgagaaaatcctaaaccagatgactcacgtaataaacacccatatcgccgaatacggcaaccccgacgaaatccggatcgaaatggcccgcgatatgcaagcaaactccaaacaacggaaggccatgacggccgcaatcacagaagctaccaaacgcaacactcaattcatcgaggaaatccagaaggagttcggattcaacccgtccaaaaacgaccttatcaaatacaaactctggaaagaactcgcgcctctcgggaacaaaacactatacagcaacatatacataccaaaagaggaactcttcacagccaagttcgaaatagaacacatcataccacgagcccttttctacgacgactcgttctccaacaaaacactcgagctaaactctgtgaacaagctcaagggtaacaaaacggcgctcgactacctcgacaccttaggccaagagaaggccaacgactacatcctacgggtagaggaactgaaaaagatcggcgcaatcactcaagccaaatacaagaaactcctaattcgcgaaaaagatctcggggacgacttcaccaatagggacctgacgaacacgcgctacatcatcaggcatgcggccgacatgctcctgcaagtaaccccaagcattgtccacaccaatggatccataaccgctatccttcgcagagactggggcctgcttgacattcttaaagaactcaacctacctacatacgagtccattgaccgtaaaatatctgaccccgaagaaaaactcacccagtcagtagaccgcaaagacggccaggcaatcaagatgattaaagattggtccaaacgggacgaccatcgtcaccacgctatggacgcgctgatcaccgccctgacaacacgtaaacacgtccaatacctcaacggcaacagcggcgctgaagaaaccgacaaagcgcagaaactggaacaacttaaagcgctccgaaaacagttaatcggctcagacggacactttatacccccgatgcacgacatccgggttcaggccaaagaagcgttgtcccgagtaatcatcagcaccaaggtaaaaggcaaagtaaccaccccgaacacgaatatcatctgttcacgagacaaaacgacgggccgaaaaatatacgtcaggcaaaccacacttacgccgcgcggagccctacacctcgacacaaaatacggaatcaaccgatactaccaagaacgagaagtttccatcggatcaaaattaacccaagaagaaatccggctagtatcctcgccccacatccagtccattctactagagagactccgcgccttcgacaacaaccccaaaagtgccttcaccggacgcaactcagtagacaagaaacctctggaagacaaaaataagaaactcgtgtacacagacaagaaagtaaaacagacgatcctcgccaaccgattcgtgaaacgtgaccaagtaaattccaaacttaacctcgacaaagttatcgacacagggattaaacgcatcctcgagggacggctccaacaatatggcggcaagtacgagaccgcattcagcgacctcgaaaacaaccctatctggctcaacgaggagaaggggatcgcaatcaaaagtgtacgaatccgcggcaaaaacaacgctatacccatacaccaaaccgacacatgccccatagactacgtagcaaacgacaacaatcaccacctcgcagtctacgtactaccggacggcaccatcgaggacgatatcgtcacctttttcgatgcggtcgaaaggtcacgccagggactgcccatcgttgacaaaaacaaaaaccagtccctcggttggaaattcctcttctccatcaagcaaaacgagtacttcctactcccacagcaggcggaaaagatagacatcgacacgggagaaataagcacccaaaccactttctctccaaaagatctgtcacctgagtacataatgaatccagacaattatgcagaacttgcctcccacatattcagagtgcagtcaatatccaaaaccccgcaaggcaaccgagacgtacgaatatacctctttaagcaacaatatatcagtggctcacaaaaagactcgcttcacctcaaagggataacctaccgccaaatctcttccgccaaagacctcgctgaactcgtcaaaatcagagtgaaccacctaggaaggatcgtatcagtgggagaaaaatga

SEQ ID NO: 6823 - RNA, 4287 nt, synthetic construct
  misc_feature 1..4287: note = Cas9 variant
  source 1..4287: mol_type = other RNA
atgaccaaaaagatcctaggcctagacctcggcacaacaagcatcggatgggcgtacgtaatcgagagcgacaatccagacgagagcgaaatcaagcaaataggcgtacgcgtcaaccccctcacgaccgacgaacagaccaactttgaaaagggtaaaccatttagcataaacaaagaacgaacactaaagcgcggagcacgacggaacctggaccgatacaaagacagacggaacaacctcatcgaagtgctgaaaaaggccaacatcctctcccaggacagcatcctaacagaggaagggcagcacacgacccaccaaacctggcaactgcgagcaaaggcagcagtcgacaaaatagaaaaagaagaacttgccagagtgctactagccataaacaagaaaagagggtacaaaagctcaagaaaagccaaaaacgaggatgaaggtcaagccatagacggaatggccgtcgcgaagcgcctatacgacgaacaaataacctgcggacagctcgtctaccagcttctccgggagggcaaaaagagcatccccgacttctaccgaagcgacctccaagccgagttcgacaaggtctggaacttccagaaacagttctaccccaaaatcctcaccgacgaattttacaaagaactcaaaggaaaaggccaacgggccacttcagcactcttctacaaaacatacaacttcaacacggccgaaaataaaggatccagagaagagaagaaaatccaagcctacaaatggaggagcgaagccatatctcagcagcttgaaaaggaagaagtagctttcgttcttacggaaatcaacaacaacctaaacaacagcagcggctacctgggcgccataagcgacagaagtaaggaactatacttcaacaagcaaaccgtaggacagtacctctaccagcaactacaagaaaatcggcacgcccgactgaaaaaccaggtcttctacagacaggactatttagacgagtttgaagctatttggaaagagcaagcgaagcaccacacagagctaaccgaggaactaaaggccgaaataagagacatcatcatattctaccaaaggaaactcaagagccagaaaggccttatcagtttctgcgagttcgaaagccgagaaattcagatcgacggcaagaagaaaacgataggactacgagtagcgccaaaaagcagtccccttttccaagagttcaaaatctggcagaacctcaataacgtcctagtaagaaagaaaggcagccgaaaaagaaacgtcaaacaagaaatacaaggctccctcttcgaggaggaaaaagaaatcttcgtcttcgacctagaaaccaaagaaaaactgttcgaggaactaaacctcaaaggtaacctctccgcaaacaaagtcattgagctcctcggacacaaaccaacagagtgggaaatcaattattccgccttggaaggaaaccgaaccaaccaagccctctacaacgcatacctgaagatactagacatagaaggatacgacgaggacctgctaaaactcagcgacaaggacgatatcaacgtcgcagacttaaaaacgccggcctccgagattaaaaacatggtacgggacatattccaagtgttagggatcagcaccgacatactagagttcgacgcagaactggacggaaaggacttcgagcagcaggcctcgtaccagctatggcacctcctgtatagctacgaaggcgacgactcacaaagcggcaacgagaaactctacgagctactcgaaaagaaattcggattcaagaaagaacactcgcaagtcctcgcaaacgtcacactatccgacgactacggcaacctcagtagcaaagccatgaggaaaatctaccccttcataaaagaaaacaactacagcaccgcgtgcgagctggcaggctaccgccatagcaaacactccctcacaaaagaagagatcgagaaccgaccactagacgacaaactagagctcctgaagaaaaactcactaaggcagcccgtagtggagaaaatcctgaatcaaatggtaaacgtagtaaattcacttctcgagaaaaatcggaaagaaaatccagacttccgattcgacgaaatccgcatcgaactggccagagaactaaagaagaatgcgaaagaacgggcagaaatgactacaaacatcaacagcgcgaaaacagaaaacgaaaagatcttcaaactactgcaagctgagttcggactcaaaaaccccaccagaaacgacatcatacgatacagactctatgaagaactcaaaaacaacgggtacaaggacctatacaccaataaatacataccccgagaaatactgttcagcaaacaggtcgacatcgaacacataatcccccagagtcggttgttcgacgactcctttagcaataaaacaatagtgtaccgagaaactaacctcgacaaaggaaaccaaacggccttcgactacatcgacagcaagtacggcaacgaaaaagtggaagaatacatcctcaggatcgaggctctccacgacgcatggaagaaaaacaaggaagaaggaataagcaaggcaaaataccaaaaactgctcaagaaggagacagagataggagacggattcatagagcgcgacctcagagaaagccagtacatagcgaaaaaggcaaaagagatgttattcaagatcacccgaagcgtcgtcagcaccagcggctcgatcacggacaaactgcgcgaagactggggactgataaacatcatgaaggaactcaacctgccaaaataccggtccctggggctaaccgagatgcaggaacgcaagtttggccagaaagtcgaagtcatcaacgactggaccaagaggaatgaccacagacaccacgcgatggacgcactcaccgtcgcattcaccaaacataaccacatacaatatctcaattacctaaacgcgcggaaaaacgagaaccataaactgcacaacaatataatcgccattgaaaacttagagacagagacgatgatcgacaacaacggctccaaacgacgggtcttcaaagcgccaatgccaaatttccgacaagttgccaaagagcacctggagaacgttctaatatcgcacaaagccaagaacaaggtggtcaccaagaacaaaaacaaaatagctggcaaagtcgcggcacaagagacactgacaccccgtggacaactacacaaagagaccgtctacggcaaataccaatactacgtaaacaaggaagagaaaatcgggacaaaattcgacgaagaaacaattaacaaagtcagcaacccacagtatagaaagctgcttctcgaacgactatcggcgaacgggaacgacccgaagaaagcattttccggcaaaaacgcactcagcaagaaccccatatacctgaacgaaaccaaaaccgaaacggtaccggaagtagtaaagctgacatggctagaagaggactactctatccgtaaagacataacgcccgacaacttcaaagacgagaagtcaatagacaagattctagacgagggagttaagcgaatactcaaaaagcgcctacgcaaaaacgacaacgaccccaagaaggctttctcagacttagacaaaaaccctatctggctcaacgaagaaaaagggatcagcatcaaacgcgtgacaatctccggcgtaaacaacgccgaaccgctacactataagaaggaccacttcggcaacgacatactcgacgagaagggagataaaatcccagtagatttcgtctcaacgggcaataaccaccacgttgcagtttacagagacgaaaaaggaaacctccaggagaatatagtctcgtttttcgaggctgtcatccgggtaaaccaggggctgcccataatagacaaagcctacaaccaacacctgggatggcaattcctatttaccatgaagcaaaacgagatgttcgtcttcccgaacgaaaagtccggcttcaacccacaggaaatagacctcttggacccatcaaacaagaagaagatctcgcccaatctattccgcgtacagaaaatgtccaaggtaatctacggaaactcgcccgttagggagtacgtgttccgtcaccatctggagactaacgtggacgagaaaaaggaactaaaggacataaccttcaagaacataaagtccctcggttacttcgaagacatagttaaagttagaatcaaccacctgggcgacatcgtgtcagtcggcgagtactga

SEQ ID NO: 6824 - RNA, 4293 nt, synthetic construct
  misc_feature 1..4293: note = Cas9 variant
  source 1..4293: mol_type = other RNA
atgaaacacatactcggcctcgacctcgggaccaactcgatcggctgggcggtagtcaaagaagcacaaaacgacaatgaacaatcggaaatcgtagacgtcggagtgcgcgtgaacccgctaacaacggacgaaaagaccaactttgagaaaggaaagcctatatcgaccaacgccgaccgaacactcaaaagatcggcgcgacggaacctccaaagatacaaacttcgacgtaaagaactaatagagctactcaaggaacaccaactaatctccactgacacaatcctaaccgaaaacggcaaaggaacgacattccaaacactcgaactacgtgcgaagtccgcaaaagagaagataagtctagaagaactagcaagagtattccttacgatcaacaagaaacggggctacaagagctcgcgtaaggcaaagaacgaagacgaaggtcagctcatcgatggcatggaaatcgcaaaaagactctacgaagaaaacctcacgacagggcagctgagcctccaactgctgaaagaaggcaaaaagagcttacccgactactaccgctccgacctgcaattcgaactagacaaagtgtggaacttccaaaaacaattccactccgacatactaaccgacgagttctacgcacagctgaaaggcaaagggcaaagagccacatccgcccttttcctcgcaaagtaccaaatctacacagccgaaaacaagggaagccgcgaagacaagaaacttcaagcctaccagtggcgcgtggatgctctatcgaaagaactcacccgcgagcagctagccttcgtaatcaccgaaataaacaacaacctaaacaacagctcggggtacctcggcgccatctcggatcgatcgaaagaattgtacttcaacaacgagaccgtcggagaatacctttggaagcagatagccgccaacccacacaccagcctcaaaaaccaggtcttctatagacaagactacctcgacgaatttgagcaaatatggaagacccaatcagccttctacccggaaatccttacagacgaactcaagaaagagctcagagacgtcgtcatcttctaccaaagaaaactgaaatcccaaaagtctctagtcagcttctgtgagttcgagaacaaggaaatagagataaagaaagaagacggcacctcgacgaaaaaggtaatcgggctgaaggtcgccccaaaatccagcccccttttccaagagttcaaaatatggcaaaacctcaacaatgtacttatacggaagaaaggcagcaaaacaaagaaagttgccaaaaatcaacaggcagtattattcgaagaagagaaaacgatcagcgaactcgacctcgaagcaaaacaggcactcttcaacgaactaaatttgaaaggtaacctaaaggcggactactgcctcgagatactaggctacagccccaaagagtgggagatgaactacagcgtactagaaggaaacaggaccaacaaagcactatacgaagcatacctgaaaatcaccgatctcgaagggtacgacgccaaaaaccacctcaaagtcaaactgaacaaggacgaggtcgagctcgacgacctaaaagttccggcaagcgaaattaaggacatggtccaggcaatattcaaagaggcaggaataaacacagacatcctccacttcaacgcagaacttgacggaaaggacttcgaaaaccaggcctcataccaactgtggcatctcctctatagctatgagggagacgattcaaagtcagggaacgagctcctctacaaactcctagaaaccaagtttggttttaaaaaggagtacgcccaaatactagccaacgttagcctaagcgacgattacggcagcctctccacgaaggccatgcgaaagatacacccctacatcaaagaaaataagttctcgacagcctgcgaactagcaggctaccgccacagcaagcactcactaaccaaggaagagaacgacaaccgcgtgctaaaagacagcttggaagtcctaaagaaaaacagcctccggcaacccgtagtagagaaaatcctaaaccaaatgataaatctcgtcaacgccctactaaagaagtatcgcacagaaaatccaaacttcaaatttgacgaaatccgcatcgaactcgcccgcgaactcaagaagaatgcggaagaacgagcgaatatgaccgcgaacataaataaggcaaaaaccgaacacgaaaagataattaagatcctgaagaatgagttcgggctgccaaaccccacacgaaacgacataatccggtaccggctctacgaagaactgaaggccaacggctataaagacctatacacaaacataaagattccccaggaaaaacttttcaccaaagaaatagacatagaacacatcatcccaaagagccgagtattcgacgactcgttctcaaataaaacgcttagtttccgcaaaacgaacctcgacaagggcgaacgaacagcctttgactacatggaaagcaagttcggcgcagacaaacttgaagagtacgtcgcccgagtcgaagacctctacaagaacaacatcatctccaaggccaaataccagaaactgcttaagaaggaatcggagataggcgacggattcgtggagagggacctcagagaaacccagtacatcgcgaagaaagccaaggaaatcctactccagatcacgcccaacgtactgagtacgtcgggcgggatcacggaccgcctgcgggaagactgggacctaattaatgtgatgaaagagctcaacctaccaaagtaccgagcccttgggttaacccaaatggaagacagaaagtacggccagcaggtcgaagtcatcacagactggacaaaacgaaacgaccaccggcaccatgcaatggacgctctaaccgtcgccttcacaaaacacaaccacatacaataccttaactacctgaacgcgcgtaaaaatgagaaacacaaggagcatagcaacatcatgggtattcaacaactcgaaaccatcaaggtcaccgacaagaacggaaacgaaaagcgtgtcttcaaggcaccgatgcccaacttccgccaggtgaccaaggcattcctggagaacatactgatctcacacaaagcgaaaaacaaagtggtgaccaaaaacaaaaacaaggtcgcaggcagcaataaagtccaagaagttctgacacccaggggtcaactgcacaaagagaccgtctatgggaagtaccaatactacgtacaaaaagaagaaaagataggtgccaaatttgatctagaaaccatcaagaaagtagcaaaccccttataccagagcttactcaaaaagcgtttagaggaaaacggaggggatccgaaaaaggccttcacgggcaagaatagcctagccaaaaaccccatatatctagacgacacacaaacagaacaactaccagagaaagtcaagctagtttggcttgaaaacagcttctcaatccgcaaagacatcactccagaaaacttcaaagacgagaaactcatcgacaaaatcttggatgagggggtcaagcgaatcctgaaggaacgattacagagctttgggaacgacgccaagaaagcattctccgatttagacaaaaaccccatatggctaaacaaggagaaagggatcacaatcaagcgagtcacaatcagcggcgtagccaatgctgagccgctgcacaccaagaaagaccacctaggcaaagaaatattagacaaagaaggcaaacccatccctgtagacttcatcagcaccggcagcaatcaccatgtggcagtttaccgagatgaaaaaggaaatttacaagaaaaggtcgtatcggtatttgaagcggtcgtacgcgcgaaccaaggactacctatcatcgataagacctacaatcaacacctcggctgggagttcctcttcacaatgaaacaaaacgaaatgttcgtcttcccaaacgagtcgacggggttcaacccaaacgacatagacctgctagaccccaagaacaaacgcataataagcccaaacctattccgcgtacaaaagttctcaaaactccaatacggcaacagcttcgtgcgcgagttcgtgttcagacaccacctagaaaccaccgtagaagaccgcaaagaactacaagggatcacatacaaacaaatgaaaaactcgaccttcttcaacgatatcatcaaagtgcgaataaaccacctaggcgacatcgtctcaatcggggaatactga

SEQ ID NO: 6825 - RNA, 4293 nt, synthetic construct
  misc_feature 1..4293: note = Cas9 variant
  source 1..4293: mol_type = other RNA
atgaaacacatcctaggcctcgacctaggaacaaactcgataggctgggcagtagtcaaggaagcccaaaacgacaacgaacagagcgagatcgtggacgtaggagtaagagtcaaccccctaaccacagacgagaaaaccaacttcgaaaaagggaaacccatatcgaccaacgccgaccgaacactcaaaaggtctgcacgccggaatctgcaaagatacaaactccgccgcaaagaactcatcgagttactgaaagagcaccagctcatcagcaccgacacgatcctgacggaaaacggaaaaggcacaacattccaaaccctcgaactgcgggcaaaaagcgccaaagaaaagatctccctcgaggagctggcacgcgtattcctgacaattaacaaaaagcgcggatataagtccagccgcaaggccaaaaacgaagacgaaggccaactaattgacggcatggaaatcgcaaaacggctctacgaagaaaaccttacgaccggtcagctgagcctccaactactcaaagaaggcaagaaaagcctgcccgactactaccggtcagacctacaattcgaacttgacaaagtctggaacttccagaaacaattccacagtcacatcctcaccgacgagttctacgcccaactcaaaggcaaaggccaacgagcgacaagcgcgctgttcctcgccaagtaccagatctacaccgccgaaaataaaggaagccgagaagacaagaaactccaagcataccaatggcgggtagacgcactgagcaaggaactgaccagggaacaactagccttcgtcataacggagataaacaacaacctgaacaacagcagcggatacctcggagctatcagcgaccgctcaaaagagctctacttcaacaacgagacagtcggtgagtacctttggaaacagatcgcggcaaacccccacaccagcctcaaaaatcaagtcttctatcgccaggactaccttgacgagttcgaacagatctggaagacacagagcgctttctaccccgagatactaaccgacgagctaaagaaagaactgcgggacgtagtcatcttctaccaaagaaaactcaaaagccaaaaatcactggtcagcttttgcgagttcgaaaataaggagatcgagatcaagaaagaggacgggaccagcaccaagaaagtcatcgggctaaaagtggctcccaaatcgagcccactcttccaagagttcaaaatttggcaaaacctgaacaacgtccttattcgcaagaaagggagcaaaacaaagaaagtggataaaaaccagcaagccgtactcttcgaagaagagaaaacaatcttcgaattagacctcgaagcaaaacaagcactattcaacgagctcaaccttaaagggaatttaaaagcatactactgcctcgaaatcctggggtactcgcccaaggaatgggaaatgaactactcagtcctagaagggaacagaacaaacaaagccctatatgaagcctacctaaagataactgacctagaaggatacgacgcgaaaaaccacctgaaggtcaaactaaacaaggacgaagtggagctcgacgacctcaaggtgcccgcatccgaaataaaagacatggtacaagccatcttcaaagaagccggaattaacacagacatcctacacttcaacgcagaactcgatggaaaggatttcgaaaaccaagccagctaccagctctggcacctcctatacagctatgagggggatgactccaagagtggcaacgaactactgtacaagctcctggaaaccaaattcgggttcaagaaagaatacgcacaaatcctggccaacgtttccctgtcagacgactacgggtcgctatccaccaaagcgatgcgcaaaatacacccctacatcaaagagaacaaattcagcaccgcttgcgaactagccggataccgccactcaaaacactccctcactaaggaggagaacgacaatcgcgtactcaaggacagcctagaagtactaaagaaaaactcacttagacaaccagttgttgagaaaattcttaaccagatgatcaacctcgtcaacgccctactgaagaaatatagaacagaaaacccaaacttcaaattcgatgaaatccgaatagaactcgcccgagagctaaagaaaaacgcagaggaaagagctaacatgacagtcaatattaacaaagctaaaacggaacacgaaaagataatcaaaatcctgaaaaacgagttcggcctacccaacccgacgcgcaacgatattattcggtaccgtctatacgaggaactgaaagcaaatggatataaggacctctatacgaacgaatacatagaaaaacaagatctattcaccaaaaatatagacatagaacatattatccctaagagccgcgtcttcgacgacagtttttcgaacaagaccctcagcttcagaaagaccaatctagacaaaggcgaaagaacggcatttgactacatagagtcaaagttcggcgccgacaagctagaagaatacgtcgccagagtagaagatctatacaaaaacaacatcatctctaaagccaaatatcaaaaactgctcaaaaaggaaagcgaaataggagatggattcgttgaacgagacctaagggagacacaatacatcgccaaaaaggccaaagaaatattactccagataacacccaacgtcctctccaccagcggagggatcacggaccgcctgagagaagactgggatttgatcaacgtcatgaaagaattgaacctcccgaaataccgggcactggggctcacacaaatggaagaccgaaaatacggtcaacaagtcgaggtaatcatagattggacaaaaagaaacgaccacaggcaccacgcgatggacgccctaacggtcgccttcaccaaacacaaccacatacaatacctaaattacctcaacgcacgaaagaacgaaaaacaccgagaacacagcaacataatgggaatccagcagctagagaccataaaagtcaccgacaaaaacggcaacgaaaagcgagtcttcaaagcccccatgccgaacttccgtcaggtgactaaggccttcctggagaacgttctaatttcgcacaaggctaagaacaaagttgtcaccaaaaacaaaaacaaagtcgccggcagtaacaaagtccaggaagtcctcaccccacgaggacagcttcacaaggaaaccgtgtacggtaagtaccagtactacgtacaaaaggaggagaaaataggaggaaaatttgacctggaaaccatcaaaaaggtcgcaaaccctctatatcaaagcctcctgaagaaacggctagaagaaaatgggggagacccgaagaaagccttcaccggcaaaaacagcctagccaaaaaccctatctacctggatgacgcacagacagaacagctccccgaaaaggtaaaactcgtatggctagaaaactccttctccatacggaaagacatcaccccagaaaacttcaaggacgagaaactaatcgacaaaatactagacgagggcgtaaagcgaatactaaaagagcgactccagagctttggcaacgacgcaaagaaagccttctcagaccttgacaagaaccctatatggctcaacaaggagaaaggaatcgcgattaaacgggtagccatctcaggcgtcgccaatgcagaaccactgcacaccaaaaaggaccacctggggaaagaaatactcgacaaggaagggaagtccatacccgtggactttatcagcacaggaaacaaccaccacgtcgccgtctaccgagacgagaaaggcaacctgcaagaaaaagtagtgtcggtcttcgaagcagtcgttcgagccaaccaaggtctccccataatagacaaaacctacaaccaacacctggggtgggagtttttattcacaatgaaacaaaatgaaatgttcgtattctcaaacgaaagcacaggtttcaaccccaatgacatagacctccttgacccaaagaataaaaagataatatccccaaacctgttccgggtacaaaaatttagcaaactccagtacggtaatagcttcgtccgagagttcgttttccgccaccacctcgaaaccacagtcgaagataggaaggaactccagggtataacctacaaacaaatgaaaaactcggcattcttcaatgacataataaaagtacggataaaccatttgggagggatcgtctcggtgggcgaatactga

SEQ ID NO: 6826 - RNA, 4293 nt, synthetic construct
  misc_feature 1..4293: note = Cas9 variant
  source 1..4293: mol_type = other RNA
atgaaggacatactggggctagacctaggcaccaatagcatcggttgggccgtggtaaaggaagcacaaaacgacaacgagacctcagaaatagtagacctaggtgtacgggtcaatcccctaacaacagacgagaaaaccaacttcgaaaaaggaaaacccatctcaactaacgcggaccgtaccctgaaaagatcagcacgccgaaatctacagaggtacaaactccgacgaaaagaactcatagaactcctgaaggaacaccaacttatatccaccgatactatcctcacagaaaacggtaaaggcacatcattccagacccttgaactgcgagcaaagagcgcaaaagagaaaatttccctagaagaattggcccgtgtattcctaacgataaacaagaaacgcgggtataaatccagcagaaaagcaaagaacgaggacgagggccaactaattgatggaatggagatcgcaaaacgcctgtacgaagaaaacctaacgacgggccaattatcattacagctacttaaggaaggcaagaagagtctacctgactactaccggtccgacttgcaatttgaactagacaaggtgtggaacttccagaaacaattccacagccacatactcacggacgagttctacgctcagctaaaaggcaaagggcaacgcgcgacctcagccctctttctcgcgaaataccaaatctacacagccgaaaataaagggtccagagaagacaaaaagttgcaagcataccaatggcgggtagacgcactcagcaaagaactaacccgggaacagctagcctttgtcataacggagatcaacaacaacctcaacaactcctcagggtacctaggcgccatcagtgaccgcagcaaagaactgtatttcaataacgagacagtgggcgaatacctatggaagcaaatagccgccaacccccacacatcccttaaaaatcaagtcttctatcgccaagactacctcgacgaatttgagcaaatctggaacacacaagcccaattctacccccaaatcttaaccgacgagcttaaaaaggaactccgggacgtcgtgatcttctaccaaagaaagctaaagtcacagaaaagcctcgtgagcttttgtgagttcgagaacaaggagatcgaaattaagaaagaagacggcacaagcaccaagaaggtaatcggcctcaaagttgccccgaaaagctcaccgctattccaagaatttaaaatttggcaaaacctcaataacgtgctaattcgaaagaaaggatcgaaaaccaaaaaggcggcgaaaaaccaacaagctgtcctcttcgaagaggagaaaaccataagtgaactcgacctagaagccaaacaagcactatttaacgaactcaacttaaaaggcaacttaaaagcagattactgcctcgaaattctgggctatagccccaaagaatgggaaatgaactattcggtcctagaaggcaacagaaccaacaaagccctgtacgaggcatacctaaagattactgaccttgaagggtacgacgccaaaaaccacctaaaggtcaagctcaacaaagacgaagttgaacttgacgacctgaaggtgccggcctccgaaataaaggacatggtacaagcaatcttcaaggaagctggcatcaatacagacatccttcacttcaacgcggaactcgacggcaaagacttcgaaaaccaggcgagctaccagctatggcacctactatacagctatgaaggggacgactcaaaaagtggaaacgaactcctatacaagctcctggagacgaaattcggcttcaagaaagaatacgcacaaatattagcaaacgtgagcctgagcgacgactacgggtcgctcagcaccaaagccatgcgaaaaatccacccttacataaaggaaaacaaattttcgacagcctgcgaactggcaggctaccggcacagcaaacacagccttaccaaggaagaaaacgataacagagtgctcaaagactccctcgaggtcctcaagaaaaacagcctgcgccaaccggtcgtcgaaaagatcctgaaccaaatgataaacctggtgaacgccctactcaagaaataccgcacagaaaatcccaacttcaaattcgacgaaatcaggatcgaactcgccagagaactaaagaaaaacgcggaagaaagagccaatatgacagccaatatcaacaaagcaaaaactgaacacgaaaagatcatcaaaatcctcaaaaacgagttcggcctccccaacccaacccgcaacgacatcatacgttaccggctctacgaagaactgaaagcgaacggatacaaagacttgtacaccaacatcaaaatcccacaggaaaaactcttcaccaaagagatcgacatcgaacacataatcccaaagagcagagtattcgacgactcgttcagcaacaagacactcagtttccgcaaaacgaacctagacaaaggagaacgaacggccttcgactacatggaaagcaagttcggcgccgacaaactggaagagtatgtcgcccgcgtcgaagatctatacaaaaacaacattatctcgaaagcgaaataccagaagctcctaaagaaagagtccgagataggggacggcttcgtcgagcgagacttacgagaaacgcaatacatcgccaagaaagcgaaagaaatcttgctgcagatcacaccgaacgtactatctacttcgggcggcataaccgaccgcctccgagaagactgggacctaatcaatgtaatgaaagagctaaacctccccaaataccgagcactaggcctaacagaaatggaagatcgaaaatacggccagcaagttgaagtaatcatcgattggacgaagagaaacgaccaccgccaccacgccatggatgccctgaccgtggcgttcacaaagcacaaccacatacaatacctgaactacctaaacgcgagaaagaacgaaaaacacaaagaacacagcaacataatgggcatccaacaactcgaaactataaaagtcaccgacaagaatggcaacgaaaagcgggtcttcaaagccccaatgccaaactttcggcaggtcaccaaagcattcctggagaacatactgatcagccacaaagcaaagaacaaagtcgtcaccaaaaacaaaaacaaagtagccggttcaaacaaagtacaagaagtacttacacccagaggccaactccacaaagaaaccgtatacgggaagtatcaatattacgtgcaaaaagaggagaaaatcgggggaaaattcgacctcgaaacgatcaagaaagtagcaaacccgctttaccaatcgctgctaaagaaaagactagaagaaaacgggggagacccaaagaaagcgtttacaggcaaatattccctggccaaaaacccgatctacctggacgacgctcaaacggagcaactacccgaaaaagtcaaacttgtctggttggaaaatagcttctcaatccgaaaagacattaccccagaaaacttcaaagacgagaaactcatcgacaaaatacttgacgaaggagtcaaacgcattctgaaagaacgactacagtctttcggcaacgacgcgaagaaagcgttcagcgatttggacaaaaacccaatctggctcaacaaagaaaaaggtattactataaaacgggtaactatcagcggagtagcaaacgcagaacccttgcacacgaagaaagaccacctcggaaaagaaatcctggacaaagaaggaaaaccgatacccgtagattttatcagcaccggatcgaaccaccacgtagccgtctatagagacgagaaaggcaacctccaggaaaaggtcgtatcagtgttcgaggcggtcgtccgagcaaaccagggcctacccatcatagacaagacatacaaccaacacctgggctgggagttcctcttcaccatgaagcaaaacgaaatgttcgtatttccaaacgaatcgaccgggttcaacccaaacgacatcgacctactagatccgaaaaataaacggataatctcccccaacctcttccgcgtacagacgataagcgtggtaaaatatggaaacgccatcgtcagagacttcaagttcagacatcatctggagacgacagtggaagacaagaaagaactacaaggcaaaacctaccagcagataaaaagtctatcgccgcttaacgacatcataaaagtccggatcaaccaccttggtgatatcgtgtccgtgggggagtattga

SEQ ID NO: 6827 - RNA, 4293 nt, synthetic construct
  misc_feature 1..4293: note = Cas9 variant
  source 1..4293: mol_type = other RNA
atgaaacacatactcggtctggatttaggcaccaacagtataggatgggcatacgtcaaagaagccgaaaacgacacggagaccagcgagattgtggacctaggggtccgagtaaacccgctaacaaccgatgaaaagacaaacttcgaaaagggaaaacccataagcaccaacgccgaccgcacactcaagaggagtgcccgccgtaacctccagagatataaactccgccgcaaggaactaatcgagctcctcaaagagcaccaacttataagtgaaaacacgattttaaccgaaaacggcaaaggcacaacctttcaaacactcgaactacgggccaagtcagcaaaagagaagataagcctcggggagctagcacgcgtgttcctgacgataaacaagaaacgcggctacaaaagctcccgaaaagccaaaaacgaagacgaaggacagctcatcgacggcatggagatcgcaaaacgactatacgaggagaacctcacaactggccaattaagccttcaactcctaaaagagggcaaaaagtcattgccagactactacagaagtgatctccaattcgaactagacaaagtctggaacttccaaaaacaattccatagcgatatactcaccgacgagttctatgcccagctcaaaggaaaagggcaaagggccacaagcgccctcttcttagcaaagtaccaaatctacacagccgagaacaaaggctcacgtgaggacaaaaagctgcaggcctaccaatggcgggtagacgccctctcgaaagagctcacaagagaacaactcgccttcgttataacggaaataaacaacaacttaaacaactcgagcggctacctcggcgccatctcggaccgttcgaaagaactatacttcaacaatgagaccgtcggcgaatatctatggaagcaaattgccgccaacccacacacctccctcaagaaccaggtcttctataggcaagactacctggacgagttcgaacaaatctggaacacccaagcccaattctacccccaaatcctcacagacgaactgaagaaggaactacgagatgtggtaatcttctaccaaaggaagctcaagagccaaaagtccctagtttccttctgcgagttcgaaaacaaggagatagaaatcaagaaagaagatggtacgagcaccaagaaggtcatcggactcaaagtcgcccctaagtcgagcccgctgtttcaagagttcaaaatatggcaaaacctcaacaacgtcctaatacgtaaaaagggcagcaagaccaaaaaggccgccaagaaccaacaggccgtcctattcgaagaagaaaagacaatatccgaactagacctggaagcaaagcaagccctattcaacgagttgaacctcaaaggcaacctaaaagccgattactgcctggagatcctaggatacagccccaaagaatgggaaatgaactactccgtactcgaaggtaacaggaccaataaggcactatacgaagcctacctcaaaattacagaccttgagggatacgacgcgaaaaaccacctcaaagtaaaacttaacaaggacgaagtagagctagacgacctcaaagtgcccgcatccgaaatcaaagaaatggtacaagccatattcaaggaagcaggaataaatacggatatactccactttaacgccgagctcgacggaaaagacttcgaaaatcaagctagctaccaactctggcaccttctatactcctacgaaggcgacgacagcaagagcggtaacgaactcctctataagctactcgaaaccaaattcggttttaaaaaggagtacgcccagatactggccaacgtgagcctctccgacgactacggaaacctctccactaaagccatgagaaaaatatacccatacatcaaggaaaacaaattcagcacagcctgcgaactggctgggtaccgtcacagcaagcacagccttaccaaagaagagaacgataatagggtcctaaaagacagcctagaggtactgaagaaaaactctctacggcaacccgtcgtcgaaaagatactaaaccaaatgataaacctagtcaacgccctactaaagaagtatcgcaccgagaaccctaacttcaagttcgacgagatacgcatcgaactagcacgggagctaaagaaaaacgcagaggaacgcgcgaatatgaccgctaatatcaacaaagccaagaccgagcacgagaaaatcatcaaaatcctgaaaaacgagttcggactgcccaacccgacccgcaatgacatcatacgataccgcctctacgaagaactcaaggccaacggttacaaagacctatacacaaacatcaaaatcccccaagaaaaactattcaccaaagagatcgacatagaacacatcatccccaagagccgagtcttcgacgactcgttctccaataagaccctcagcttcaggaaaacgaacctagacaagggggaacgtaccgccttcgattacatggagagcaaattcggagccgacaagctagaggaatacgtcgcccgagtagaggatttatacaagaacaacataatatcgaaggccaaataccaaaagctcctgaagaaagagagtgaaataggcgacggcttcgtagagcgagacctgagagaaacacagtacatcgcaaagaaagcaaaagaaattctactgcaaataacgcgcaacgtactgtcgacaagcggaggcataacagacaggctccgcgaagactgggacctggtcaacgtcatgaaagagctcaacctaccgaaatatcgtgccctcgggctcactgaaatggaagacagaaaatacggacaacaagtggaagtcatcatagactggaccaaacgtaatgaccatagacaccacgctatggacgcactcaccgtggcattcactaagcacaatcacatacagtacctaaactacctcaacgcgcgaaagaacgaaaaacacagagaacacagtaacattatgggaatccagcaactcgagacgatcaaagtaaccgataaaaacgggaacgaaaaacgcgtattcaaagcccccatgccgaacttccgacaggtcacaaaagcattcctagaaaacgtgctcatcagccacaaagcgaagaacaaggtggttaccaaaaacaagaacaaggtggctggctccaacaaagtccaagaggtgctcacccctcggggacagctgcacaaggaaacggtctacggcaaataccaatactacgtccaaaaggaggagaaaatagggggcaaattcgacctcgaaaccatcaaaaaggtcgcaaaccccctctaccaaagcctattgaagaaaaggcttgaggaaaacggaggcgaccccaaaaaggcattcaccggcaaaaactcactcgccaaaaacccaatatacctcgacgacgcccagaccgagcaattaccagaaaaggtcaaactcgtatggctggagaacagctttagcatacggaaagacatcacaccagaaaacttcaaggacgaaaaactgatcgacaaaattctggacgaaggagtaaaacgcatcttaaaagaaagacttcagtccttcgggaacgatgccaagaaagcattcagcgacctcgacaaaaaccccatctggctgaacaaggaaaagggcatcactatcaaacgcgtgacgataagcggtgtcgcgaacgccgaacccctacacaccaaaaaggaccatctaggcaaggagatactagacaaggagggaaaacccatcccggtagacttcataagcacaggaagcaaccaccatgtcgccgtctaccgtgacgaaaaggggaacctccaagagaaggtcgtatccgttttcgaagccgtcgtccgcgccaatcaagggctaccaatcatcgacaaaacatacaacgaacatcttggatgggagttcctcttcaccatgaaacagaacgaaatgttcgtcttccccaacgaatccaccggattcaaccccaacgacatcgatctactagatccgaaaaacaaacgcataatctccccaaacctgttcagagtacaaaccatctcagtcgtaaagtacgggaacgccatcgtacgagacttcaagttccgccaccacctagaaacaacagtcgaagacaagaaagaactgcaggggaaaacgtaccaacaaatcaaatctctaagccccctaaacgacatcatcaaagtcaggataaatcacctaggagatatagtttcagtgggggaatactga

SEQ ID NO: 6828 - RNA, 4293 nt, synthetic construct
  misc_feature 1..4293: note = Cas9 variant
  source 1..4293: mol_type = other RNA
atggcgcaaaagtatattctaggcttggacctagggaccaattccataggatgggccgtcgtcaaggaagcagaaaatgacaacgaacagtcagaaatagtcgacgtcggagttcgagtcaacccactgacaacagacgagaaaacaaactttgaaaaggggaaacccatctcaacgaacgcagaccgaacactgaaacggggagctcgccggaacttacaacggtacaaactgcgacgaaaggaactaatcaaaatcttaaaagagcaccagctaatcagcgacgataccatactcgctgaaaacggaaaaggcacgacataccaaaccctgaagctgagagcaaaaagttcaaaagaaaagataagcctcgaggaattagcgcgggtctttctgacgataaacaagaaacgcggctacaaatccagtaggaaaacgaaaaacgaggacgagggacaactaatcgacggcatggaaatagcaaaaagactctacgaagaaaacttaacgacaggccagctaagcctccaactgctgaaagaaggaaagaaaagcctgcccgactattaccggagcgacctcgagctcgagctcgacaaggtatggaactttcagaaacagtttcatagcgacatcctcacagacgaattttacacgcaactgaaaggcaaggggcaaagagccaccagtgcactatttttagagaagtaccaaatctacacagtcgaaaataaaggcaaccgggaagagaaaaacctccaggcataccaatggcgcgtcgacgcgctctcaaaagagctcacaagagaggaactggccttcgtaatcacagagataaacaacaatctcaacaactcgagcggctatcttggcgccataagcgaccgctcaaaggaactctatttcaacaacgagaccgtaggcgagtacctctggaagcaaattgccgctaacccccacacctctctgaagaaccaggtattctaccggcaggactatctagacgagttcgaacgcatatggaacacacaagcacaattctacccacaaatactcacggaaagcctcaagaaagagctgagggacgtggtaatcttctaccagcgcaagctaaaatcacaaaagagcctggtgtcattttgcgagttcgaaaacaaggaaatcgaaataaagaacgaagacggaacaacaacaaagaaagtaatcgggctgaaagttgcacccaaatcctccccgctattccaggagttcaagatctggcagaaccttaacaacgtcttaatccgcaagaaaggcagcaaaactgaaaaagtcgcaaagaaccaacaggtcgtcctgttcgaagaagagaaaaccatctctgaactggacctggaagccaagcaagcccttttcaacgagctcaacttaaaaggtaatctaaaagccgactactgcctcgagattctaggttatagcagcaaagaatgggagatgaactactcggtcctcgagggtaacaggacaaacaaagccctgtacgaagcgtacctaaaaatcaccgatctcgagggttacgacgccaagaactacttgaaagtaaaatcgaacaaggacgaagtcgaactagacgatctgaaagtgccggcttcagagataaaagaaatggtccaagcgatcttcaaagaagcgggcataaacacagacatcctccactttgacgcagagctcgacggaaaagattttgaaaaccaggggtcttacaagctctggcatctgctatactcatacgaaggcgacgacagcaagtcgggaaacgagctactctataaactactagaaacgaagttcggcctcaagaaagaatacgcccagatactagcgaacatttccctaagcgacgactacgggaacctgtccacaaaagcgatgcggaagatccacccgtacatcaaggaaaacaagttcagcacagcctgcgaactcgcagggtatcgccactccaaacacagcctaacaaaagaagagaacgagaagcgcgtactcaaagacggcctcgaagtgctaaagaaaaacagcctgcgacagccagtcgtcgagaaaatactcaatcagatgataaacctagtcaacgccctactaaagaaataccgaaccgaaaaccccaacttcaaattcgacgagatcagaatcgaactggcacgagaactaaagaaaaacgccgaagaacgagccaacatgactgccaatatcaacaaagcgaaaacagagcacgagaaaattgacaaaatccttaagtcagaatttgggctccctaaccccacgcgcaacgatataataagatatcgcctgtacgaagaactcaaggccaacgggtataaggacctatacaccaaccgatacatcagtagcgagaaactattcagcaaagaaattgacatagaacacatcatcccaaagtcccgcgtattcgacgactccttcagcaacaagacaatagtctacaggaccgataacctggacaaaggcgaacaaaccgcctacgactacatcgaaagcaagttcggcgcggaaaaattaaaagaatacatgacccgcgttaaagacctataccagaaaaagatcatatccaaagccaagtaccaaaaactcctaaagaaagaatcggaaatcggcgatgggttcgtcgaaagggacctgcgggaaacccagtacatagccaagaaagcgaaagagattcttctacaaatcacccacaacgtcctgtccacctcgggaggcatcaccgaccgactaagaaaggactggggccttgtcaacgtaatgaaagaactaaacctacccaaataccgggcattaggtctaacaaaaatggaagaccgaaaatacggccagcaagtggaggtaataaccgattggacgaaacgaaacgacctaagacaccacgccatggacgcactcaccgtcgcatttaccaaacataaccacatacaatacctaaactacctcaacgcaaggaaaaacgaaaaacacaaagagcacaacaacatcatggccatccaacaactcgagaccatcaaagtcaccgacgagaacggtaatgaaaaacgaatcttcaaagcgcctatgccgaacttccgacaagtagcaaaaacattcctagaaaacgtattaatcagccacaaggccaagaacaaagtcgtcaccaaaaataagaacaaaatatcgggaagcaacaaagtccaggaagtcctcacacctcggggccaactacacaaagagaccgtatacggcaaataccagtactacgtccagaaagaagagaaaattggcgcaaaatttgactcagaaacgatagaaaaagtcgccaacccgctataccaaagcctgctcaaaaagcgccttgaggaaaacggaggagacccaaagaaggcattcacaggaaagaactccctcgccaaaaacccaatctacttggacgacacacaaaccgaacaattgccagaaaaagtaaagctagtctggcttgaaaacagcttttccatacgaaaagacataaccccagagaactttaaggacgaaaagctcatcgacaaaatcctcgacgaaggagtgaaacggatactcaaggaaagactacagagcttcggcaacgacgcgaagaaagccttctccgacttggagaaaaacccgatctggctgaacaaagaaaaagggatcgcaatcaaaagggtcaccatctcaggggtggccaacgctgaaccactacacaccaagaaagaccacctcggaaaagagatcctagacaaagaggggaaacccatccccgtggacttcatctcgaccggcaataaccaccatgtggccgtatacagagacgaaaaagggaacttacaagagaaggtcctgtccgtcttcgaagcggttgtaagggcaaatcaaggactcccaatcatcgagaaaacgtacaaccaacacctaggatgggaatttctcttctcaatgaaacaaaacgagatgttcgtatttcccaacgaatcaacgggattcaaccccaacgatatcgatctgctggaccccaaaaacaagcgtatcatcagcccaaacctattcaaggtacaaaaactcgcaactaaaaactacatgttcacacaccacttagaaacaaaatccatcgacggagacatgctgaaaaacaaaaaggaactctccgggattctatataacttcatccaaactccacaaaaactgtatggaatcatcaaagtccgcatcaaccacctaggcgacatcgtgtcggtcggcgagtactga

SEQ ID NO: 6829 - RNA, 4296 nt, synthetic construct
  misc_feature 1..4296: note = Cas9 variant
  source 1..4296: mol_type = other RNA
atgaaacggatccttggactcgacctcggctcctcaagcataggctgggccctcgtaaacgaggcagagtcaaagaacgagcgaagctccatcgtaaaactgggcgtacgcgtcaatcccctcacggtggacgagtccataaatttcgaaaagggcaagtccatcactaccaacgcagaccgaacattgaaacgcagcatgcggcggaacttacaccgctacaaacttcgccgtgaagctctaatcgaagtcctgaaagaatgtaaattcataactgaagacacaatacttagcgagaacggaaaccgcacaacattcgaaacatatcgactgagggtaaaagccctcaccgaagaaataagtcttgaggaatttgctagagtcctgatcatgatcaacaagaaaaggggctacaaatccagccgcaaagccggcggtgccgaagaggacacactgatagacggcatggacatcgcccgcaagctgtatgatgcgaacctcacaccgggcgaactatgcctacaactcctctcagcgggcaagaaagtactgccggacttctacagaagtgacctacaaaacgaactcgaccgcatctgggagaaacaaaaagagtactaccctgggattctcactgcagccctcaaggaggaactccgaggcaagaaacgcgacgccgtatgggcaatctgcgccaacgcgttcgtgtggaaagagacctacaccgaatggaacaacgaggagagcaaaaacgagcagatagagaaagaacacaaactcgaaggcatctatagcaagcgcaagagagatgaagccaagaaagaaaatctccagtggcgcgtgtctggcctcaaagaaaaactatccctggagcaactggtcatcatacttcaggaaatcaacactcaaatcaacaactcaagcggctacctcggcacaatatcggaccgctccaaagaattgtacttcaacaaacaaaccgtagggcagtatctaatggacatcctcgacaacaacccaaacgccagcttaagaaacatcgtcttctaccgacaggactacctagacgagtttaacgtcctatgggagaagcaagcagagttccacaaagaactaacaggagaactaaagaaagaaatccgagacataatcatattctatcagcgccgcctgaaaagccagaaagggttaatatccttctgcgagttcgaatccaggcaaatcgaagtaaagatagacggtaaacgaaagataagaacggtaggaaacagagtgatcccccggagcagcccgttgtttcaagagttcaaaatctggcaaatcctcaacaacatcgaagtcaccgccgttggtaacaagaacaaacaacgcatgcagaacggaagcaacgagccagacgacacagaacaactcgaattgaacggaagacgatacctataccaggaggaaaaagagctcctggcaaaggaactgttcgtccgagacaaaatgacgaaactcgacgtcctacgtttactgttcgacaaccccgaagaacttgacctaaacttcaaaacaatagacggcaacaaaaccggctaccttttcttccaggcatactcaaaaatgatagagatgtccggccacgaacccgtagacttcaagaagccaatcgaaaagattgtcgagcaagtcaaatccgtcttcgtcctacttaactggaacacagacatcctatcatttgactcaaacaaggaattagacaagcaaagctactacaaactttggcacctattgtacagcttcgagggcgacaatactcccacgggaaacgggtgcttagttcagaagataatggacagctacggcctaggcaaggagttcgccaagattctagcaaacatcacatttcaagaggattacggaagtctgagtgcaaaagccatccacaaaatacttccgcacctcaaagagggtaaccagtacgacgtcgcctgcgaatacgccgggtaccgccactctaaaagtagtttaaccaaagaggagatcgcaaacaaggtgcttaaagataagctagaagtgctgccacgaaacagcctacgcaacccggtcgtagagaaaattttaaaccaaatggtaaatgtaattaacgccataatagaggcatatggcagacccgacgagatccgagttgaacttgcaagagaactcaagaaaaacgctaaagagcgggaaaaactcacaaaatcaatcgcggaaaccacgaagacacacgaggcgcacaagaaactactccaagaagagttcggactcaaaaacgtcggcaggagcgacatactacgctacaaactatacaaagaattagaaagccgcggctacaaaaccctctacagcaacacatatatccccagagaaaagctgttctccaaggagttcgatatcgaacacatcatcccccaagcccgcctcttcgacgacagcttcagcaacaaaacactagaagcacgaaacgtaaacatagaaaagggtaaccgaacggcgtacgacttcgtaaaggaaaagttcggagagtcgggaactgacaactcactagattgctacctgaacaacattgaagttctgttcgtgtcaggaaaaatcagcaagaccaaatacaccaagctgaaaatgaccgaacaggacattccgggagggttcatcgaacgagacctaagaaacacccagtacatcgcaaagaaagcgcttagcatgctcaatgagatatcccgttgcgtagtcgcgacgagcgggagcatcaccgacaaactacgcgaggactggcagctcgtcgacgtaatgaaagagctaaattgggagaagtacaaggccctggggctcgtagagtactttgaggacaaagatggaaaacagatcggacgcatcaaagattggagcaagcgcaacgaccaccgccaccatgccatggacgccctcacagtagcattcaccaaggaggtattcatacaatacttcaacaacaagaacgctagtctcaaccccaatacgaatgagtacgccatcaaaaacaaatacttccaaaacggacgtgccatagccccaatccccctgaacgagtttcgggcagaagccaagaaacatcttgagaacacacttatatcaatcaaagcgaaaaacaaagtcatcactaacaacataaacaaaaccaaaaagcgcgggggagtaaatacaaagaagcaacaaacaccccgcggccagcttcacctagaaacaatctacggatgctgccgacaatacctcaccaaggaagaaaaagtaaatgcctccttcgacgtctccaaaatagcgacagtgagctccagtgtctatcgggacgccctccttaagcgactacaggaacaccacaacgacccaaagaaagcattcgccggacgcaacagtctcgacaagaaaccagtttggttagacaaagaacaaatcagaaaagtcccggaaaaagtcaaaaccgtcacattcgaaactatatacacaatccgaaaagaaatcagcccggaccttagagtcgacaaaataatcgatagcggagtacgcaaaatgcttacgggcaggctaaaagaatacggaaacgacgcgaagaaagcctttagcaaccttgacgaaaaacccatctggctaaacaaagaaaaagggatcccgataaaacgcgtcaccatctccggaatcagcaacgcgcaatcccttcacgtcaaaaaggataaggacgggaaaccagtgctcgacggcaatggccgtaacatccccgtcgacttcgtaaacacgggaaacaaccaccatgtagccgtgtaccgcagaccagtaatcgacaaaaatggccagatggtcatcgacgaaaacggcaacctcaaatacgaactcgaagaagtcgttgtcaccttcttcgacgcagtaacaagagtaaacctcggacaaccgataatagacaaagattacaaggcctccgaaggctggcagttcctcttcagcatgaaacagaacgagtactttgtcttccccaacaagaaaacaggattcaaccccaaagaaatcgacctactcgacgcagacaactacggcctgatatcgccgaacttgttccgagtgcagaaattcacgcataagaactacgtattcaggcaccacctagaaaccaccatcaaggacacgtcaagcatactacggggaatcacgtggatcgacttccggagcagtaagggcctggactcaatagtgaaagtacgggtaaaccacataggacaaatcgtcagcgtaggagagtattga

SEQ ID NO: 6830 - RNA, 4299 nt, synthetic construct
  misc_feature 1..4299: note = Cas9 variant
  source 1..4299: mol_type = other RNA
atgaagaaaatactaggactagatctaggtagcaacagcataggatgggccctagtcaacgaggccgaaaacagagacgaagcatcatcgatcataaagctaggggtgcgggtaaacccactcacggtcgacgagatgcagaactttgaaaagggaaagagcatcacaaccaacgcggacagaacactcaaaaggtccatgagacgcaacctgcagcgctacaaactacgacgggacgcgctcatcaaactgctgaaaaaggtggggttcatagcagacggtaccatactaagcgaacaagggaaccgctcgactttcgaaacatatcgactacgggcaaaggccccagacgaggaaataagcctgcaagaactagcaagagtactcctcatgatcaacaagaaacgtggctacaaaagcagcagaaaaatcaaggaaaaagaggcaggcaccctaatcgacggcatgaaggtggcgaagaaactctacgatgaggacctaacaccgggacagctctgcctgcagctcctggagtcgggaaagaaatcactgccagatttttactcgagcgaccttcaagaagagttcgaccgaatatggaatttccagaaacaattcaatccaaaagcattttgcgacacagccaaagaggaaataaaaggcaagaacaaatcgcagacttgggccattctagccaagtacttcatttggacagacgagatggtagtctggaacgaaaaggagtcaaaaaccgagagggtcgaaaaagaatgcaagctagtgggcctaaaacgcacggtgaagaaagaagaacagcgaaaagaaaactaccgatggcgggtccaggcactcaccgaacaactcgacctagggaaagtagccgtcgttctgcaagaaatcaatggacagatcagcacgtcaagtgggtacctaggagcgataagcgataggtccaaagttctatactttaaccggcaaaccgtgggacaataccaaatggctgagctcgagaaaaatcccaacacgtccctcaggaacatggtattctaccgacaagactacctcgacgagttcgacaaaatatgggaaaaacaagcggagttccacaaagaactgacagtagagctaaagaaggagatccgtgacatcatcattttctatcaacggcgcctcaagtcgcaaaaaggcctaataggcttctgcgagttcgaaaaccgagaaataatggttgaaaagaacggcaagatgcaagccaaagtcgtcggctgcaaagttattcccaggagtcacccactgttccaagaatttaagatctggcaaaccctgaacaacgtcgaggtatttgccggtgagaagaaatgcaaacgcaagcgaacggacgcattccccggactcttcgacgggaccgaggacaccctaatggtagaaggctggcgctacctataccaagaagaaaaagaaatccttgcgaaagaactgtccgtcaagaaatccctcaagaaagaatacatactaaaactgctgttcgacaacccccaagacttggatatgaacttcgagcaaatcgaaggcaacgacaccggaaacgtcctgttcagcgcatattccaaaatgatcgaaaagtacggatatgagccacttgatttcggaaagtccacagacgaaatcatagagcgcctacaagtcatattcacggatctcggatggaacaccgacctcctgttcgtagacctaaacaaggaaggaaaagacctcgagaaacagccctacttcaaactctggcacctcttatacagcttcgagggagacaataccccaacaggcaatggcaagctggtcgagaaactcatggagctctgccacgtcgggaaagaatgcgccttggaactcgtcaacatcagctttcagaacgactacggctcgctaagcgccaaagcaataaagaaaatcctaccctatctaaaagaagggaatcgatacgacgtcgcatgcggatacgcaggatacaggcactcaaaatcctccttgacgaaagaagaaatcgaaaataaagtcctaaaagataagctagacatattacccaaaaatagcctacggaacccagtaatagagaaaatcctaaatcagatggtcaacgtaatcaatgcgatcatcgacacatacggaaaacccgacgaaatcagagtggaattggcacgcgaactcaagaaatcagccaaagagcgcgacgaactgacaaaagcaatagctaaaagcacacgagagcacgaggagataagaaaggtcctacaggaagagttcggcatgatcaatgtcagtcgcaacgacatcatcaggtataaattatacgaagaactcaaagacaatgggtacaaaacgctctacagcaaccagtacataccgaaggagaaggtcttctcaaaagagatcgacatagaacatataatcccccaagccagactcttcgacgacagtttatcaaacaaaaccctcgaatacaaagccataaacattgaaaaaggcaataaaacagcctacgacttcgtcaaggaaaagtacggcgaaaaaggtctgcagcaatacctaaaccgctgcgaaagcctgttcaaaggacaccgcaccaaactaagaaaactgaaaatgggacaagaaaatataccagagggattcatagatcgagatctccgaaacacgcaatacattgcaaagaaagcactcgcaatgctcaacgagatctgcagacgagtagtcgcgacgaccggctcaataacggaccgcctgcgcgaagactggcagctggtagacgtcctgaaagagctaaatctacccaaatacgaaacactcggcctcgtcgaagtatatgaagacaaagacggcaggaaaattaaaaggatcaaagattggacaaaacgcaacgaccacaggcaccacgctatggacgccctaaccgtcgcattcacaaaggacgtcttcatacagtacttcaacaacaaaaacgcggcctggcaagctgattgcaaagaacattcagatatcataggaatcaaaacgaggtactttgaaaacggacgcgcactaccacccatgccactggtgcgtttcagagcggaagccaaaagccacctggagacactgctcgtgagcataaaggcaaagaataaagtagtcacaaataacgtaaattgtactaaacggaaagggggcgagaacaagaaactgcaacagacgccccgcggacaactccacctggagaccatttacgggagccaccggcagtacgtgatgaaagaggaaaaggtcaacgcctcgttcgattcctccaaaatagccacagtctgcaaacaggcctaccgcaacgcgctcttagaacgcctagcagccttcggcaacgacccgaaaaaggcgttcaccgggaaaaactcgctagagaaaaacccggtctacctcgatcgggaacagaccgctcgagtaccagaaagagtcagaacagtagaactcgaaactgtgtacaccataagaaagccagtcgacccgaacctttccgtagacaaagtcgtcgacgccaaagtacgaagcatcctggaacaacgcctgagagaatatgacggagaagcgaaaagagcgttcgtcaatctggacgaaaacccaatctggctaaacgaagagaagggcatcgccataaaacgcgtaacaatccgcggcatcaacaaagtccagagcttacacgggaaaaaggacaagaatggcaacctaatcctggacgaaacaggaaagaaaattcccgtagacttcgtcaacacgggcaacaaccaccacgtcgccatatacagaaaaccagtcctggacaaaaccggccaagagatgctagacaacgaaggcaacccggtatacgaactcgacgaggtcgtggtgagctttttcgaggctgtaaccagggtaaacctaggcctgcccgtgatagacaaaaactacaacaaaagtgaaggctggcaattcatgttcacgatgaaacagaacgaatacttcgtgttccccaatgagaaaacagggttcgaccctaaggaagtcgacttactcaaccccgaaaactacgccgtcatctccccaaaccttttccgcgtccagaaaatcacagaaaaggactacatgttccgacaccacctagaaaccaaagtagtggacgacaaattcttaaaagaaataacctggaaacgcatactaacaccgaacaagctcgagggcatagtaaaagtgcgtgtcaaccacatcggacagatcgtatccgtcggggaatactga

SEQ ID NO: 6831 - RNA, 4299 nt, synthetic construct
  misc_feature 1..4299: note = Cas9 variant
  source 1..4299: mol_type = other RNA
atgaagaaaatattaggcctagatctaggcagcaacagcataggctgggcgctagtaaatgaagcagaaaactctgacgaagtcagctccattatcaagttaggtgtcagggtcaaccccctaaccgtcgacgaaatgcagaactttgagaaaggaaaaagcatcacaacaaatgctgacaggactctcaaaagatcgatgcgcagaaacctgcaacgatacaaactaagaagagacgcactcataaagctcctaaagaaagtggggtttatcacggacggcaccatactcagtgaacaaggaaacagaacaacgttcgaaacctaccgactacgagccaaggcgccagacgaagagatatcattgcaagagctggcccgggtcctcctaatgataaacaagaaacggggctacaaatcctcaaggaaaatcaaagagaaagaggcgggaaccctgattgacgggatggaggtggccaagaagctctacgacgaggacctaacaccagggcaactctgcctacagctcctagagagcgggaaaaagtcgctgccggacttctactcatcggacctacaagaagaatttgaccgcatctggaacttccagaaacaattcaatcctaaagccttctgtgacacggccaaggaggagataaaaggaaagaacaagtcccagacatgggcaatattagccaaatacttcatctggaccgacgaaatggtcgtctggaacgaaaaagagtcaaaaacagaaagagtagagaaagagtgcaagttagtaggactcaaacgcaccgtaaagaaagaagaacagcgcaaagagaactactgctggagagtacaggccctcacggaacagctggacctagaaaaagtggcagtcgtccttcaggaaataaacgggcagatcagcacaagctcaggctacctaggggcgataagtgaccgttcgaaagtcctctactttaaccggcaaaccgttgggcagtaccagatggcagagcttgaaaagaaccccaacacaagcctacgcaacatggttttctaccggcaagactacctcgatgagtttgacaagatatgggagaaacaggccgaatttcacaaagagctaacagtggagctaaagaaagaaataagggacataatcatcttctaccagcgccgtcttaaatcgcaaaaaggactgatcggcttttgcgagttcgaaaaccgtgagatcatggtagagaagaacgggaaaatgcaagctaaggtggtgggctgcaaagtaatcccccgcagtcatcccctgttccaggagtttaagatatggcaaaccctcaacaacgtggaagtcttcgcgggagaaaagaaatgcaaacgcaaacgcactgacgcttttcctggcctgttcgacgggacagaagacacgctgatggtagaaggctggcgctacctgtaccaagaagagaaggagatactcgccaaagaactaagcgtcaagaaaagcctcaaaaaggaatacatcctaaaactactgttcgataatccccaagacttggatatgaacttcgaacagattgaaggcaacgacacaggaaacgtactcttcagcgcctacagcaaaatgatagaaaagtatggatacgaacccctcgacttcggcaaaccaacggacaagatcatagaacaactacaagtgatattcgccgacctaggatggaacaccgatctcctcttcgtggacctaaacaaagagggaaaagacctcgaaaaacaaccatatttcaagctctggcacttgctatacagcttcgaaggagataacacaccaaccggcaacggaaaactcgtagagaaactaatggaactctgccacgtagggaaagagtgcgcactcgaactcgtaaacatctccttccagaacgactatggctccctgagtgcaaaagcaatcaaaaagatcctcccgtacctgaaagaggggaaccgctatgacgtagcatgcggctacgccgggtaccgacacagcaaaagctcattaaccaaagaggagatagagaacaaagtgctcaaagataagctagacatcctacccaaaaacagcctccgaaacccagtcgtcgagaagatactgaaccaaatggtaaacgtaataaacgcgataatagacacgtacgggaaaccggacgagatacgggtcgaactagcgagggaactaaagaaatcagcaaaggaacgggaggaacttaccaaagccatcgcaaagagcacaagggaacatgaagagatccgaaaagtcctccaagaagagttcggtatgatcaacgtgtcaaggaacgacataatacgatacaaactgtacgaggaactcaaagacaatggatataaaaccttatacagcaaccaatacattccaaaggagaaagtattcagcaaggagatagatatagaacacataatcccgcaagcgagacttttcgacgacagcctatccaacaaaacgctggaatataaagcaatcaacatcgagaaaggcaataaaacagcttacgacttcgtaaaagaaaagtacggggagaagggcctccaacagtatctaaatcggtgtgaatcactgttcaagggacaacggaccaaactacgcaagctgaaaatgggacaagaaaacatacctgaagggttcatcgatcgagacctccgcaacacacaatacatagcaaagaaagcactcgcaatgctcaacgagatatgccgccgggtggtagccactacaggcagcataaccgacaggctcagagaagactggcagctcgtcgacgtgcttaaagaactaaacctcccgaaatacgagactctaggcctagtcgaggtgtatgaagacaaagacggaaggaaaataaaacggattaaagactggacgaagcgaaacgaccaccgccaccacgcaatggatgccctgactgtcgcattcaccaaggacgttttcatacagtacttcaacaataaaaatgcagcgtggcaagcggactgcaaagagcactcagacattattggcatcaaaacaagatacttcgaaaacggacggtcactacccccgatgcccctagtccgcttcagagccgaagcaaaatcccacctcgagactctactcgtctcgataaaggccaaaaacaaagtagttactaacaacgtaaactgcacaaagagaaagggtggcgagaacaagaaattacaacagtcacccagaggacaactccacctggaaacaatctatggatcacaccggcaatacgtcacaaaagaagagaaagtaaatgcctccttcgacagctccaaaatcgccaccgtgtgcaaacaagcctaccgaaacgccctcctcgaacggttagccgcgttcggaaacgacccgaaaaaggcattcacaggcaaaaactccttggagaaaaacccagtgtacctaaacagggaacaaacagcccgtgtccccgaacgcgtgcgcaccgtcgaactagaaaccgtctacaccatccggaagccggtagaccccaacctatccgtagacaaagttgtcgacgccaaagttaggagtatactggagcagcgcctgcgcgaatacgatggcgaggcgaaaagggccttcgtgaacctagacgaaaacccaatctggcttaacgaagaaaaaggaatagcgatcaaacgggtcaccatacgagggatcaacaaagtgcagagcttgcacggtaaaaaggacaagaacggaaacctaatcctcgacgaaacagggaagaaaatacccgtggacttcgtgaacacaggaaacaaccaccacgtcgcaatataccgaaaaccagtcctgaacaaaaccgggcaagaaatgttagacaacgagggcaatccagtatacgagctcgacgaggtagtggtgagctttttcgaagctgtcacccgagtgaacctaggactaccggtcatagacaagaactacaacaaatccgaaggatggcaattcatgtttaccatgaagcaaaacgaatactttgtattcccgaatgagaaaactcggttcgatccaaaagaagtcgacctcctcaacccagaaaactacgcagtcatttcacccaacctgttccgcgtccagaaaatcacagaaaaggactacatgttccgacaccacctagagacgaaggtagttgacgacaaattcctgaaagagatcacatggaaacggatcctgacacccaacaaactagaaggaatcgtaaaagtccgcgtaaaccatatcgggcaaatcgtctccgtaggagaatactga

SEQ ID NO: 6832 - RNA, 4299 nt, synthetic construct
  misc_feature 1..4299: note = Cas9 variant
  source 1..4299: mol_type = other RNA
atgaagaacatcttaggccttgacctcggcacaacctctatcggattcgcccacatagtagaagatgaaaataaagaaaagtcggagataaaggaactaggggtccggatagtcagtctgaccaccgacgaacagtcggacttcgaaaaggggaaatcaatcaccacaaacgcgaacagaactctaaaacatggagcgcgactgaacctggaccgctaccaacaaagacgcaaatacctcatcgacctccttcacaaagcgaacctcataacaccgtcatcaatcctggcggagaacggcaaaaacaccacacattccacgtggcaactccgcgcgaaagctgtcaccgagcggattgaaaaggaggagttcgcccgaatcctcttggccataaacaaaaagaggggatacaagagttcgcggaaagccaaaaccgaggacgaaggacaagcgatagacggaatggcaatcgcaaaacgtctctacgacgaaaacctaacccccggccaactcagcctacagcttctacaacaaaacaagaaacttctaccggacttctaccggtcggacttacagaaagagttcgacctcgtatggaacttccaaaaacaattctaccccgacatcctgaccgatatattctacaaagaacttcaaggaaaaggaaaggatgcgaccagcaaggccttttcgaaacgctaccactttgacacagcggaaaacaaaggctccaaagagagcgtaaggctccaagcctaccagtggcgcgctgaggctgtcagtaagcaactcagcaaagaagaggtcgcctacgtgctcaccgaaataaacaacaacctgaacaacgcaagcggctacctcggtgcaatctcagatcgcagcaaagaactctacttcaaccgacaaacagtcggacaatacctctacgcacaactacaagaaaaccgacataactccctcaagaacaaggtcttctaccgacaagactacctagacgagttcgagcgcatatgggaaacacaggcccttttccacaaggaactcaccgacgaactgaagaaacagatccgcgacgtcgtcatattttaccaacggaagcctaaaagccagaaaggcctaatctccttctgcgaatttgaaagcaaagaaatcgagatcgagaaagatggcaaaaccataacaaagaacataggagctcgggtcgtccccaaatcctcaccacttttccaggagttcaaaatctggcaaattcttaacaacgttatttgcaaaagaaaaggcatacggaaaaagaagatatccgccaaaacgacccaactcgacctcctaaacgaaagctcccagaccatcttcagcctagacatggagtgcaaacaactcctgttcgacgaactgaaccttaaaggagacttgaaaagcgacaaagtcctaaaacttcttggctactcaccacaagagtgggagataaactacaaccagctcgaaggaaatagaactcagaaagccctttacgaagcgtacctcaaaatcgtcgagatggaggcccacgatgtaaaggatatcctccaaataaaaagcaccaaagatgactggtcactcgacgaaagccccctatccgctagcgaaatacgagaaagcgtcaaagctatcttccaagcgttagggatatgtaccaaaatactatacttcgaccccctattaccggtaaaagactttgaggagcaagactcctaccaactttggcatctgctgtatagctacgaaagcgatgacagcacatccgggaacgagacactctaccggatcctggaaaagaaatatgccttcaaacgagaacacgcccgcatcttggcaaacgtcgcactccaggacgactatggctcactgtccactaaagccatacgaaaaatttatccaaacatcaaggagaaccaatacagcaccgcctgcgaaatggccggctacaagcactccaagctatcattgaccaccgaagaactggaagcgcgagaactaaagaacatcatccccctcctgaagaaaaacgccctccgcaaccccgtagtcgagaaaatattaaaccagatgatcaacgtagtaaatgccctcatcgagaaaaactccgaacgagacgccgaaggcaagataacaaagtacttccactttgatgaaatcagaatagaactcgcccgggagctaaagaaaaacgcccaaaaacgctacgaaatgacacagaatatcaacaaggcaaaatccgaacaccaaaagatttcagaaatcctacagaaggaatttggaatcaaaaacccaacaaaatcagatataattcgctatcgcctctataaggagcttgaacacaacggatacaaggaactttacacaaacacatatatcgcccccgacgtcctgttcagcaaaaacatagacatagaacacatcgttcctaaggcccgcgtattcgacgactccttttccaataaaacacttgcgtttaaggacttcaatattaagaaaggcgaatccacagcattcgactacattacatcgctcaaaaacgaagaaaaactaaaccaatacctggcacgcgtagagaacgcctacaagaccaagaacatcagccccgcaaaatacaaaaacctactcaagaaagcctccgagataggagatggcttcatcaaccgcgacctaagggacacccagtacatcgccaagaaagcaaaagagatactcttccaagtcaccaaaaacgtcctctctacatccggtagcatcaccgaccgcctacgagaggactggagcctcgtggatgtgatgaaagaattaaatatgcccaaatatcaatccctggggctaacagaagtagaggaacgaaaagacggcaacaaagtcaccgttataaaagactggaccaaacgcaacgaccaccggcaccacgccatggatgccctaacagttgctttcacgaaaccaagctacatccaatacctgaaccacctaaacgcgcggaaagacgaaaacaacaaaaactactccgtaatcctcgccatagagaagaaagaaaccatcaaagtgccgacgaacaacggcaaaaacaaacgggtcttcatagaacccatacccaacttccgccaagtagcaaagaagcacctagaagaaatcttcatctcccacaaagccaaaaataaagtcgtaacgaagaacactaacaaacccgcaggaaccaacaagcaacaaataacactaactcccagaggacaactccacaaagagaccatatatggaaagtaccagtactatgtaaacaaggaagagaaagtaggtgtcaaattcgacaaagaaacaatcgcaaaggtatcaaatcccctgtacagagaagcactactgaaacgcttgcaggcaaacgacaacgacccaaagaaggcctttaccggcaaaaacgcactaagcaaaaaccctatctatctggacgaggccaagacaaagaccctacccgagaaggtcaacctcacatatctcgaagaggatttctcggtaagaaagaaaatcgtacccaaaaacccaacatctaaagagttcgttccaaacctgaaaagcatcgaaaaagtggtagacgaaggagtacgaaacatcctcatcgaacgcctcagagtttacaacaacgatccagagaaagcatttgttgacctagagaaaaaccccatatggctaaacaaggaaaaaggcattgcaatcaagcgtgtcacaataagcggcgtcaacaatgcccagcccctacacatcggcaaagaccatttgggtaaaacaacgctgaacaaggaaggcaaagaaataccagtagactatgtaagcacgggcaacaaccaccatgtagccatctatcgggacaaagaaggtaacctccaagaacaaatagtatcgttcttcgaagccgtggtaagaacgcaacagggtctccctataatcgataaaacgtacaagcaggaagaaggctggcaattcctatttacaatgaaacaaaacgagatgttcgtgttccccaacgaagcgactggattcaatccagcagaaatagacctactggaccccaagaacaagaaacaaatatccccaaacctatttagagtacagaaaatcgcaaccaaagactatttcttccgccaccatcttgaaacgaacgtagaaacagataatgtgctcaaaaacacgacctggaaacgagaaggcctaagtggactcaaagacatcgtaaaagtacgaatcaaccacctcggagacatcgtcagcatcggcgagtactga

SEQ ID NO: 6833 - RNA, 4302 nt, synthetic construct
  misc_feature 1..4302: note = Cas9 variant
  source 1..4302: mol_type = other RNA
atgaagaaaatcttaggcctcgaccttggtaccacctcaatcggctacgcgcaggtcaacgaaagcgaagacttcaaagacagctcaatagaacgtatcggcgtccgcgtcaacccccttagcgtcgacgaacaaacaaacttcgagaagggaaaaccgattagcataaacgccgacagaaccctgaaaagcggcgcccgacggacgctcgaccgctaccaggaccgtagatcgaatctaatcgacgcactcgtcaagagcgtcatcatcaccgaagacaccgtgctcgcggaagacggcaaaaacacaacacatagcaccttcgcgctgagggcaaaaagcgcatcagaaaaagtcgaaaaagccgagttcgcacgcatcctacttgccatcaacaagaaacgcggatacaaatcgtcccgcaaaaccaacaacaacgacgatgaaggccaagccatcgacgggatggccatcgccaagaaactttacgacgagaacctaaccccgggccaactcgcatatcaactgttgaaggagggaaagaaatacctgccagacttctatcgaagcgatctacaagccgagttcgacaagatatggaccttccagaaacaattctaccccgaaatcctgacggacgaactccagaaggaactagcgggcaaaggtcaacgcgcgacgtcagccatcttttggaagaagtacgacttcaacaccgccgagaacaagggaacgcgagaggagaaaaagctgaaagcctacgaatggcgctccacatcggttgacaagaagctgcaaaaagaagaggtagcatatgtcatcacagaaatcaacaataacctgaccaacagttcagggtacctaggagccatcagcgaccgatccaaagagctctacttcaacaaacaaaccgtcggccaatacctgttcaagcagatccagaaaaacccccacaccaaacttaaaaaccaagtattctatcgccaagactacttcgacgagttcgaaatcatctgggaaacacaagccaaattccatcctgaattaacggaagaactaaagaacaagataagagatatcatcatattctaccaaagaaaactaaaatctcagaaaggcctcatatccttctgcgagttcgaacggaaagaggtagaaatcgaaaaaggcggcagacgcatgaagaagacaatcggactaaaagtcgcacctaaaagcagccccttattccaggagttcaagatctggcaggtcctcaacaacgtactaatcagaaagaaaggttccaaaaagcgccgagtcaaggaaccggaccagctcaacctggtcgaacaggaacaagaggtcatgtttttcgacatgcagaccaaacaaaccctcttcgacgagctcaacgtaaagggaaacctaaaggccaaacgcataatcgagctcataggtcaagacgcgaacgactgggagatcaactacagtgagatagaggggaatcgaacaaacaaagccctctacgacgcgtacttaaaaatactcgacttagagggatacgataccaaagcactactcgacgtcaaaaccagcaaagatgaagttgaacttgacgacatcaacatcagcggaccagaagtcaaagacctagtaaaacgcatattcgagtcactagaaatagacacccagatactagagttcgatgcggaactcgacggggaagtcttcgaaaagcaatccagctatctgctgtggcacttactatattcctacgaaggcgacgactctccgagtggcaatgaaaaactctacaaactccttaagcagaagttcggattcaagaaggaacacgcgcaaatactagcgagcatcaccctatcggacgactacggaagtctctcagcaaaggccatgcgcaagatctacccgtacataagagaacaaacgttcgacaaagctgccagcctagccggatatagacacagcgccagttcactcaccaaagaagaaattgcgaacaggccactcaaggacaagctagagctcatcaagaaaaattcgctgagaaacccagtcgtcgagaaaatcctcaaccaggtcgtcaacatcgttaactcgctaatcgaagcaaactctgaaaaggactcagacggcaacatcatcagctacttcaagttcgacgagattcgaatcgaactcgcacgggacctcaaaaagaacgccaaagaacgggcggaaatgacactaaacatcaacgctgcaaagatcgtacatgaaaagatcttcaaactcctccaagctgagttcggggtgaagaaccccacccggaacgacataatccgctacaagctctacgaggaactcaaaaacaacggatacaaagacctgtacacaaacatctacataccgcgagaaatcctcttcagcaaacaaatagacatagaacacatcatcccccaatctaaaatgttcgacgattcgttctccaataaaacgatagtattccgtaaagacaacctagacaagggaaactccacggctttcgactacatagacagtcgcttcggcaaagacaaactaacagatttcgaacaacgaatcgagttcctcttcgaacaaggaaagaaaaacaaagaagagggaataagtaaagccaaataccagaaactgttaaaacgagaggctgacatcggcgacgggttcatagaacgagatctccgagacacccaatacatagcaaagaaagcacgtaacctcctgtacgaaatctgtcgtatagtaacaccgaccaccggcagcataactgaccggctccgggaggactgggacctcgtaaacataatgcaagagctcaacctagacaaattcaagaaactcgggctcaccgaaatggtagagaagaaagacgggtcattcaaagaacgcatagtagattggtcaaaacgcaacgaccatcgccaccacgcgatggatgcactcaccatcgcctttaccaaacatagtcatatacagtacctaaattacctaaatgcccgcaaaaacgagaaccataaacagcatcacaacatcatcggcatagagagaaaagagacagagttcgtgattgacgacctcgggaacaaaaagcgcaaattccacctacccctccccaactttcgtgaagaagccaagaaacacctagaaaatgtcctagtctcgtttaaagccaaaaacaaggtcgtaacaaagaacaagaataaaacggcctcatccaaaggcgagaaaattaaagtggaactcacgccccgtggacagctccataaagaaacggtatacggaaagtacaaattctacgtatcgaaggaagaacggatcggcggaaaatttgatcagcggaccatcgagcgcgtggcaaacagcacacataagcgactactgctccaacgtctcctagaaaacgataacgatgcaaagaaggcattcacagggaaaaacgcgcttgctaaaaatcccatctacctggacgacaccaagaccctaaccctacccgagatcgtaaaactaacgtggctagaagaagactactccatacgcaaagacatcacaccggagaacttcaaagacatcaaagtaatagacaaaatcctagatgaaggagtaaaaaggatcctaaaagaacgactagcgaagcacaacaacaaccctaaggaagcattctccgacctcgagaaaaacccgatctggctcaatgagaaaaagagcatttccatcaaaaaggtaaagatatcgggcataaacaacgccgaagccctacactacaagaaaaaccacctgggcatcgaaatactagatgacgaaaagaaaaggattccggtcgactttgtaagcaccggaaacaaccaccacgtcgccatctatcgggacgaaaaaggcaatctgcaagaagacgtcgtgagcttcttcgaagccgtggctcgcgttaaccaaaacctgcccatcatcgacaagaccctcaaagcatacctcggttggacattcctattcacaatgaaacaaaacgaatacttcattttcccgaacaagcagacagggtttaatcccaccgagatcgacctcctagactcgatgaataacaaactcatcagccccaaccttttccgggtccagaaattcaccgtgaaggactacttctttcgccaccacctggaaaccaatgtcgaggacgactccaaactcaaaaacacgacatggaaaagagaaggattaggaggtatcggcaatatcgtaaaagtgcgaatcaaccatataggacagatcgtaaaaatcggagaatactga

SEQ ID NO: 6834 - RNA, 4305 nt, synthetic construct
  misc_feature 1..4305: note = Cas9 variant
  source 1..4305: mol_type = other RNA
atgaaaaacatactaggcctggacctcggcacgaacagtatcggctgggcatacgtaaagcaagcgcaaaacgattccgaaaagagcgaaatcgccgagttgggggttagggtcaacccccttaccgtcgacgaaaagactaactttgagaaaggaaaacccatcagtacgaatgctgacagaaccctaaaacgaggcgcgagacgcaacttgcagaggtacaaactacgacgccaggagctcatagaactgctaaaggactatcaagttatctccgacaaaacgatcctagccgaagacggaaaggagaccacattcgaaacactccgacttcgcgtcaagagtgcaaaagagcaagtgagcctagaagaactggcccgtatcctcctaatgatcaacaaaaagcgtggatacaaatcgtccagaaaagccaaaaacgaggacgagggacaactgatcgacggaatggagatcgcaagacgactatacgacgaaaacctcactaccgggcagctcagcctgcaactcctaaaggaaggcaagaaaagcctacccgactactatcgctccgacctacaacacgaactcgacaaagtctggaacttccaaaagcaatttcaccccgacatccttaccgacgagttctacacctcaatccagggtaaaggccaaaaggcgactcgcgagagcttcagtagcaagtatggcatcgacaccgcggaaaacaaaggtagccgggaagagaagaaactgcaagcataccaatggcgcgcggacgccacccacaaagaactcaccaaagaggaactagcctttgtcataactgagatcaacaacaatatcaacaattcatcggggtacctaggcgcgatctcggaccgcagcaaagaactcatctttgcaaacgaaacagttggcgagtatctctggaagcagatacaaaatgacccccacacttctctaaagaaccaggtgttttaccgccaagactacttcgacgagttcgagaggatctgggaaacgcaatctggattttacccccaaatcctcaccgaatccctcaagaacgaactacgcgacatacttatattctaccaaagaaaactcaaatcacagaaagccctagtctcgatctgcgagttcgaaagcaaggaaattccactcaaagacaagcaggggaacccaatatccaaaaacggcatccccgtcacaaagctagtaggccctaaagtcgcacccaagagctccccactattccaagagttcaaaatctggcagaacctgaacaacgtactcgtgcgccccaaggggagccgaaaacgaaaggtcaccacgaatcaacaatcgaccctgctagaaggacaggaaccagtcttcgagttgaacctcgaacaaaaagaactcctcttcgaagaacttaacctcaaggggaacctcaaaaccgactactgcctagagctaataggctatagcgccaaagaatgggaaatgaactaccctacactcgagggaaacaaaacaaacaaagcactttacgaagcataccttaaaatcatcgactccgaaggctacgacgccaaaaagctcctcaaagtaaagacagacaaggacgacatcaatctcgacgacataaaagtgtcagcctcagagatcaaaacgatgatctcggatatattcaacgaattaggcataaacacaaagatcctcgacttcgacgccgaactcgagcgtaagcagttcgaagcacaggcaagctaccgactatggcatctactatactcatacgaaggggacgacagcaaatcaggcaacgagttgctctacagactgctcgaggacaagttcggatttaaaagagaacactcaaaaacactcgccaatgtctcactcctctcagactacggcaacctcagcacaaaggcaatacgaacgatctacccctacattaaagaaaataaattctcaacagcctgcgagctcgccggctaccgccatagcaaattgagcatctccaaagaagagaacgaaaaccgtaccctaaaagacaccctagacgtgctcaaaaagaacagtttgcgccaaccagtagtcgagaaaatactcaaccaaatgatcaacctgatcaacgaactgatcgaaaaacacagcgagaaagatgaaaaaggaaacattgtcaagtactttaaattcgacgaaatacacatcgaattagcccgtgagctaaagaaaaacgccgaagaacgaagagaactggactccaaagttagagaaggtaaagacagaaacgagaaaataataacaatcctcaagtcagagttcggcctgccctacccaaccaaaaacgacataacacgctaccgactttacgaagaactcaaagataatggctacaaagacttatacaccaacacatacatcccccgcgaaaaactattcagcaaagaaatcgacattgaacatatcatccccaagtcacgtttgtttaacgacagtttcagtaacaaaacaatctgctaccgccaagacaacctcaacaagggagaacgaacggcgtacgactacatagaaggattgggcaagacacaactggacgaatatctcaaccgcgtcgaaaacctctacacaaacaagttcatcactaaagcaaagtaccggaacctcctcaagaaagagtcagaaataggagatggcttcatcgaacgtgacctaagagaaacgcaatacatagcgaaaaaggcaaaggagatgctcctccaaataaccagacacgtagtaagcacaacaggaagcataacagaccggcttagggacgattgggagctagtcaacgtaatgcgagaactaaacctccctaagtataaagtactcggcctcaccgaaatacaagagcgcaagaacggacagacagtggaagtaataacagattggaccaaacggaatgaccaccgccatcacgcaatggacgcgctcaccgtagccttcacaaagcacagccacattcaatacctaaacttcctgaacgctaggaaagacgagaaacacaaggagtattccaatatcatgggcatccagcaactcgaaaccgagaaaaccaccgacaaagatggaaaagaccggcgagtcttcaagacgcccatccccaatttccgacaagtcgccaaagaacacctcgaatccatcctcatcagccacaaaaccaaaaacaaagttgtcacaagagccacaaacaaaatcgccggcagcaaaaagcagcaggagacactatctccccgcggacagctacacaaagagacagtctacggaaaatatagaagatacgtccaaaaagaagagaaaattggaagtaagttcgacctccagacaatcgaacgcgtagctaaccctctctacaaacgcctactaacgaagcgcctcgaggaaaacggaggagacccgaagaaagccttcaccggcaaaaacgccctcgccaaaagtcctatctacctagacgagacccagactcaacagcttcccgaaaaagttaagctagtctggctggaaacagacttctcgatccgcaaagacatcacccccgacaacttcaaagacgaaaaatcgatagacaaagtcctggacgaaggcatcaaacgaatcctcaaagacagactgaagtcgttcgacggggatgcaaaaagagccttcactgacctagaacaaaaccccatctggctcaacaaagaaaaaggaatcgcaatcaaacgtgtgactatatccggcgtcagtaatgcggaacccctccacactaagaaagaccacctcgggaacgaaatcttcgacgacactggtaaaccaatcccagtcgactacgtaagcacaggcaacaaccaccacatcgccatataccgcgatgagaatggaaacctccaagaaaaagcagtcagcttctttgaagcagtcacacgcgccaatcagggcctaccaaccgtagacaaaacgtacaaccaacacctgggatggcagttcctctttactatgaaacaaaacgaaatgttcgtcttccccaacaaagaaacgggattcgacccacaagagatcgacctactagacccgaagaacaagaaactcatctcccccaatctgttcagagtgcagaaaatctccaccaagaactatttctttcgccaccacctcgagaccagcgtcgaaacccataacgccttaaacggcgtcacatacaaatctcaactcggcctaaacgggataacggatatcataaaggtccgcatcaaccacctcggagatatcgtccacataggcgagtactga

SEQ ID NO: 6835 - RNA, 4308 nt, synthetic construct
  misc_feature 1..4308: note = Cas9 variant
  source 1..4308: mol_type = other RNA
atgctgggatgcgagcgcaagcgcaaacgccgcgagaaagaaaagatggccaaaccaaaggactacacaatcggactagacattgggacgaactcggtaggctgggtcgtgaccgacgaccaaaacaacatcctccgcataaaagggaaaaaggccataggcgctcgcttgtttaccgaaggcaaagttgcggccgaacgacgatcattccgcacaacgagaagacgcctatcacgtcgacgatggcggatcaagatgctcgaggaactatttgacgaagagatagcaaaggtagatccatccttcttcgctaggctgcacgagtcctggatatcccccaaagacaaacgaaaacgctactcggctatagtcttcccctcaccggaagaagataaaaagttccacgagtcgtaccccacgatataccacctacgcgacaaactaatgaaagacgaccaaaagcacgacatacgcgaaatatacatcgcagtacaccaaatgataaaagcccgtggcaacttcctccacgatgaatctgtggaaacctaccgctcaggaatgtccagcctaggtggccgaagcgaaagaaacatcctgtccgtgcaaaccctagaagaattaaacgacctgtttgcagaaaacgaaggcaccgaagaagtagagctcaacgtcgccagcgccgaacagatcaacgacatactaaccggcggacaccttaacgcggactcccaaaaagagataagtaacctcctgcttccgtccagcttcccctccttcgacgacaaggccaaggaaaaacaggtgaagaaactcattaacaacgttgcaaccaacatctcgaaggcgtggctgggctataaagcagacttcagcaccatccttaacctagcgaaggtggacaaagaccaaaagaaaatcttcgcattcgcacttcaaggaggggacgaggaagacaaagtgcaagagctcgaatccctcctcgagcagtcacaaaccgacatcgtagaccgtctcatagaaatacgtcacgccatagtgctcagcgagatagtacccgttggtatgaccctctcagaagccatgatcgacaagtacgaccagcacaaggaagatctcattacgctgaaagctgtaatccgcaacaccaaggacaaaaagaaagccgcaaagctacaagcaatctacgatctctacgtgaaaaaccgccacgctgacctcgcaaaagccatgaaacttacgggaatcaagaaacgctccgaactgctggacccggaagaactcaagaaggggatctcctccctcctcgacgactccccagaagcagtggaaatcaaacaacgactcgaagagaaaaccttcctgccgctacagcgcagcaacaacaatggagtcattccgaaccaacttcatcaagtagagctcgacgaaatcatcaaaaagcagtcaaaatactaccccttcctagccgagaaaaatcctgacgaaagcgaagaagcgcaaaagaaagcacccacaaaattagacgcactcctaacattcagggtgccctactatgtcggcccaatgataaccaaagaagaacaagaggcccagaacggccactcgttcgcctggatggttcgccgggatcctcaagaccacgaggcgataaccccctggaacttcgaaaagaaagtcgacaaaatggcttccgcaacgcaattcataaagcgtatgaccaccaaagacacatatttgctgggagaagacgtactcccagcgtcctccctaaaatatcaactattcactgtattaaacgagctcaacaacttaagagtcaacggaaagaaactgacatccgacgaaaaagagcaggtaatcgaggggctattcaagaaacagaaaaccgtcaaagcggataaatttgtcaagtactggcaggccaagcacataggagcagatataaaagtcaaggggctctcggatccttcgaaattcaattccaccatgagcacttacatcgacttcaagaaaatcttcggcgatcagctaaacgacgtcaaccgccaaaacgacttcgaaaagatcatagaatactccacaatctttgaagaccggaaaatcctcgaagacaaactacgggtcgacttcgcatggttgagcgaggaacagattaaacagctgtgccgactccgcctccagggctgggggcgactcagtgacaaacttctcacccgcctaaccgacgcggacggtcagaacgtcctcgaacgcctctggaactccaatgacaacttcgtgcagatagtgagcgatcccaatatcaaggctaagatagaacaagaaaaccaaaaactgctacgagactcacaaagcgacaatgcggtcgaaagcatcctggacgacgcatatacatcaccccaaaacaagaaagccatccgccaggtcatgcgcgtcgtccacgatatagtcaaagcgtgcgacgggaacgtaccggcaaaattcgctatcgagttcgcccggtcccaagaagacgacccaaaaagaacaacagcaagagtcaaccagatgcagaaaatatacgaccaaatatcagacgaagtcgtgagccaaggagtaaaagaacagctctcaggaatgaaaagccttaaagaccgttactacctctactttatgcaaggaggccgcgacgcctacacaggggccaagctaaacatagaccgactctcggactacgacgtggaccacatcatgccgcagagcttcgttaaagatgacagcctagacaaccgcgtacttgtcgcgcgggccgtcaacaaccagaaaagcgacaaagtacccgccctactattcggtaacaaagtagtcgccgatctcggaattaccgtacgagagatgtgggacaaatggcaaaaactaggcatgatctccaaacgaaaactttcaaacctgttaacggactccgacgctctaacagaatacagagcacaaggattcatccgacgccagctagtagaaacaagccaagtgataaaactcaccgcaacaatactccaatcagagttccccgactcaaaaatcatcgaggtcccagccaaatataattccatagtacgaaaacaattcgacctctacaagtcaagagaagtgaacgacttccatcacgccatagacgcctacctcagtacaatcgtcggcaactacctctaccaagtgtacccaaacttacgacgcatgttcgtgtatggcgagttcaagaaattctcaagcaatgctgaagaaagcgcccacgacgtcgcacgccgcgtaaagagcatgaacttcctagacgatctcctaagggggacccacggggacaacatctactgcagaagcacaggcgaaatagtgtttaaccgcaacgacatcatttcgaagctgaagcaagcatactccttcaaacaaatgttggtcacccaggaagtatttaccaagaaatcggctctattcaaccagaccgtgtacccatcccccaaacgcgatggctcaaaacgctcgggtttaatccctcgaaaacgcggcatggaccccgaaatatacgggggctacgcacacaaccaagactcctacttcgtactagcaaaaatagagaaggtgaaggggtacactctacagatcgttggcgtccccatccgctccctggagataattaataaggcagaagacttcagcaccgccctactcgacatcatcaaaagcaaggtgatgtacaacgaaaagacgggacagcccaaaagaggaattaaaaacgtagagatcctggtgaacaaactaccatatcgccaaccaatactagaaaaagacgtatcctacatgctgggatcgtccgcctacaagtataacattaaacagatcacgctcagccgccaatcgatgaaatacatactcgactacatcgacgaccccaacttcacaaaacatgaaatgacaatgatcgatgagcagaacgaacgcgagtgccttctgagtgtatacgacgagatcctcgaaaaggtagacaaatacctaccactcttcgacggaaataaattccgcgaaaaattacactccgcacgaaaagagttcgtatccctctccgtagacgacgaagcgtcagcaatagaaaagattctccggggactccacgccaacagtgaaatgccatccctcgaaaacctcaaaataaaacccgccttaggctttttccagatgaaaaacggcataacactatccaacgacgctgtcctcctctaccaaagccccaccggactcttcgagcggagagtaaaagtcagcgacctgctaaaatga

SEQ ID NO: 6836 - RNA, 4308 nt, synthetic construct
  misc_feature 1..4308: note = Cas9 variant
  source 1..4308: mol_type = other RNA
atgaaaaacatattggggcttgatctaggcaccacctcgatcggctttgcccacatcgtagaggacgaaaataaagaaaaatcagaaataaaagaactaggcgtcagaatcgttcccctcaccaccgatgaacagagcgatttcgaaaaaggcaaatcaattaccacaaacgccaaccgcaccctcaagcacggcgcccgcctcaatctagaccgataccaacaaagacgcaagtacttaatagacttgctccagaaggccaacctcataacttcatcatcaatcctggccgaaaatggtaaaaatacgacacactcaacttggcagctccgcgcaaaagccgtcacagagcggatcgaaaaagaggaatttgcacgggtcctcctggcaatcaacaaaaagcgcggctacaagagcagccgaaaagccaagaccgaagacgagggccaagccatcgacggcatggcaatcgccaaacgcttgtacgacgagaacctcaccacgggtcagctcagcctccaactgctacaacaaaacaagaaactcctgcccgacttctaccgtagcgatcttcaaaaagagttcgacctcgtctggaatttccaaaaacagttctaccctgacatcctgaccgacagcttctataaggaactccaaggaaaggggaaggacgctacctcgaaagcattcagcaagagataccacttcgacacagccgaaaacaaaggatccaaagaatcagtccgactgcaagcataccaatggcgcgtggaagcaatatcaaaacagctcagcaaggaagaagtcgcatacgtcctaacagaaatcaacaataatctgaacaacgcctctggatatctcggcgctatctctgaccgaagtaaggaattatacttcaaccgccaaacagtcggacaatacttgtacgcgcaactgcaggaaaatcgtcacaacagccttaaaaacaaagtgttctacaggcaagactacctggacgagttcgaacgtatttgggaaacccaggcatcattccacaaagaactcaccgaagaactcaagaaacaaatacgcgacgtggtcatcttctaccaaaggaaaccgaaatcccagaaaggcctcatttccttctgcgagttcgaaagcaaagaaatagaaatagaaaaggacggcaagacgatcaccaaaacaatcggcgcccgcgtagtgcccaaaagcagcccactcttccaagagttcaagatctggcaaatactgaataacgtgatatgcaaaagaaagggcatccgcaaaaagaaagtcagcgctaagactacccagctcgacctcctcaacgaatcctcacagaccatcttcagtctcgacatggagtgcaaacaactcctattcgaggaacttaacctcaaaggagacctcaaaagcgacaaggtcctgaagctgttaggctactccccgcaggaatgggagatcaactacaaccagttggaaggaaaccggacccaaaaagccctgtacgaggcctacctaaagatcgtcgaaatggaggcacatgacgtcaaagacatcctccagataaaaagcgccaaggacgactggagtctggacgagtccccactatcggccagcgagatacgcgagtcagtcaaagctatctttcaagccctcggcatctgcacaaagatactctactttgacccactcctccccgtgaaggagttcgaaaaacaagacagctaccaactgtggcatctcctttactcctacgagtcggacgacagcacctcaggcaacgaaacactgtacagaatcctagaaaagaaatacgcgttcaaacgcgagcacgtccgaatccttgccaacgtcgcactacaagacgactacggaagcctctcaacgaaagcaatcagaaagatctacccgaacataaaggaaaaccagtattctattgcctgcgagatggcaggatacaaacacagcaaactatctctcactaccgaagaactagaagcccgcgagctcaagaacatcatccccctcctaaagaaaaacgcgctgaggaaccccgtcgtcgagaaaatcctaaaccagatgatcaacgtggtcaacgcgctaatcgagaaaaacagcgaacgcgacgccgaaggaaaaataacaaagtacttccactttgacgaaatccgtatcgaactcgcccgagaactcaagaaaaacgctcaaaaacgctacgaaatgactcaaaacataaacaaagctaaactcgaacaccagaaaatttcggaaatcctacaaaaacaattcgggatcaaaaaccccaccaaaagcgacataatcaggtaccgactataccaagaactcgaacataacggatacaaagaactgtacacaaacgcttacatcgcccctgatgtcctattcagcaaaaacatcgacattgaacacatcgtacccaaggcccgagtgttcgacgactccttttcaaacaagaccctggcgttcagagagttcaacatcaagaaaggagaatcgacagccttcgactacatcacctcgctaaactccgaagaagaattaaaccaatacctgacccgagtagaaaatgcgtacaaaacaaaatcgatctccccaacgaaatacaagaacctcctcaaaaaggcgtcagagataggagacgactttatcaacagggacctccgagatacccaatacatagcaaagaaagcaaaagaaatcctgttccaagtaaccaaaaacgtactttcgaccagcgggagcatcactgaccgactgcgcgaagactggggactcgtcgacgtaatgaaagaactgaacatgcctaaatatcagagcctcgggctcaccgaggtcgaagaacggaaagacggaaacaaagtaacagttatcaaaaattggaccaagcgcaacgatcaccggcaccacgcaatggatgccctcaccgtggcgttcaccaagccctcatacatacaatacctaaaccacctcaacgcgagaaaagacgaaaacaacaaaaactattcagtaatactagccatagaagaaaaagagactattaaagtacgaaccaacaacggtaaaaacaagcgcgtcttcattgaacccatcccgaacttccgccaggtggcgaagaaacacctagaagagatcttcatcagccacaaaactaaaaacaaagtcgtaactaaaaacgtcaataaacccgcaggaaccgacaaacaacaaatcacactaacaccccgcggccagcttcacaaagagaccatctacggaaaataccaatactacgtcaacaaagaggaaaagatcggcgtcaagttcgataaggaaaccatcgccaaagtcagcaaccccctctatcgggaagctctactcaagagactgcaggccaacgacaacgaccccaaaaaggcattcacaggcaaaaacgctctatcaaagaagcccatctacctggatgaatccaagacaaaaaccctccccgagaaggtcaatctcacttacctggaggaagatttcagcatcagaaaggatatcagccccgataacttcaaggacctaaagtcaatcgagaaagtaattgaccagggcgtaaaacgtatactaatcaagagactccaagcctacgacaacgacccaaagaaagccttcgtggatttagagaaaaacccaatctggctgaacaaggaaaaaggcatcgccatcaaacgcgtaacaatttccggcgtaaacaacgctcagcccctacacataggcaaagaccacctcggcaagacaaccctaaacaaagaagggaaggaaatcccggtcgactacgtgtcgaccgggaataaccaccacgtagccatatacagggacaaggaaggcaacctgcaggaacaaatcgtctccttcttcgacgcggttgtccgcgcccaacaggggctccctatcatcgacaagacctacaagcaggcagaaggctggcagttcatgtttacaatgaaacaaaacgaaatgttcgtgttcccaaatgagaccacaggttttaacccagccgaaatcgacctcctagaccccaaaaataaaaagctcatatcaccaaacctatttcgggtacaaacgataagtgtagtcaaatacggaaacagtgtcgttagagattttaagttcagacaccaccttgaaaccacactacaggacgacaaaatactccaaggcatcacgttccagcagatcaaaagtctcgaaccactccgcaatatagtcaaagtaagaataaaccacctcggagatattgtctcaataggcgaatactga

SEQ ID NO: 6837 - RNA, 4308 nt, synthetic construct
  misc_feature 1..4308: note = Cas9 variant
  source 1..4308: mol_type = other RNA
atgaaaaacatcctaggcctcgacctcgggaccacatccatagggttcgcccacatagtagaggacgaaaacaaagaaaagtcggaaatcaaagagctcggcgtccgaatagtatccctcgccaccgacgaacaatccgacttcgagaaaggtaaaagtatctccaccaacgctaaccgcaccctgaaacacggcgcgcgccttaacctagatcgctatcaacagcggcgtaaattcctaatcgacttgctacaaaaggctaacctcatcacatcagcctctatactcgcagaaaacggcaagaacacaacccacagcacctggcaactacgtgcaaaggctgtcaccgaacgaatagaaaaagaagagttcgcccgagtcctcttagccataaacaagaaacgaggctacaaaaactcgcgcaagacaaaaactgaagacgaaggacaggccatagatggcatggctatcgcaaagtgcctgtacgatgaaaatctaacacccggacaattgagcctccaactactccaacagaataagaagctactaccagacttctaccgaagcgacctgcaaaaggagttcgacctagtctggaacctgcaaaaacagttctaccccgacatactgacagactccttctacaaagaacttcagggaaagggaaaggatgccacctcaaaagcattctcgaagaggtaccacttcgacactgcggaaaataaggggagcaaagaaagcgtccgattgcaggcgtaccaatggcgcgccgaagcaatctcaaaacaactctcaaaggaagaagtcgcctacgtgctaacagagataaacaacaacctaaataacagctccggctacctaggggccataagcgatcgatccaaggagctatacttcaaccgccaaacagtcggccaatatctatacgcccagctccaagaaaatcgccacaactccctgaaaaataaggtattctaccgccaagactacctcgacgagttcgaacgcatctgggaaacccaggcctccttccacaaagaactaacagacgagctaaagaaacagatccgggacgtcgtaatcttctatcaaagaaaattaaaatcacaaaagggccttgtatccttctgcgagttcgaaagcaaggaaatcgaaatcgaaaaagacggcaaggccataacgaaatccatcggcgccagggtcgtgcccaaatcctccccgctttttcaagaatttaagatctggcaaatactaaacaacgtaacttgcaagcggaagggcatccgcaagaaaaagtccagcgccaaaagcaccgaactagacctcttcaacgaaccatcgcagagcatattctcactagacatggagtgtaaacaactactgtttgacgaactcaatctcaaaggggacctcaaatccgacaaagtgctaaaacttctaggatactcgccccaagagtgggaaatcaactataaccaactagagggcaaccgaactcagaaaagtctatacgaagcctacctcaaaatcatcgagattgagggctacgaagtaaaagacatactacaaataaagtcaaccaaagacgattggagcctagacgaaagccccctgtccgcctcagaaatcagagaacgagtcaaagtcatcttccagacactggggatctgtaccaagatcctctacttcgacccccttctacctgtcaaagagttcgaacaacagtacagctaccagctctggcatctgctctacagttatgaatcagacgactccaccagcgggaacgaaactctctaccggatcctagagaaaaagtatgccttcaaaagagaacacgctacaatcttagcaaacgtcgccctccaagatgactatggctccctctctacgaaagcaatccgcaaaatctacccctacattaaggagaatcaatatagtacagcatgcgaactggcaggctacaaacactctaaactatcgctcacaaccgaagaactggaagctcgcgaactgaagaacatcatcccactgcttaagaaaaacgccctaaggaaccccgtcgtagaaaagatcctcaatcaaatgatcaacgtcgtgaacgctctaatcgagaaaaactctgaacgagatgccgaaggaaaaatcaccaaatacttccacttcgacgaaatacgcatcgaattagcgcgagaactcaaaaagaacgcccaggaacgctacgagatgacccagaacatcaacaaagcaaagctagaacaccagaaaataagcgagaaactgcaaaagcaattcggcattaaaaaccccaccaaatcagacataatccgctatcggctgtatcaagagctcgaacacaacggatacaaagaactctacacgaacacctacatagcacccgacgtcctcttctctaagaacattgacatagaacacatcgtaccaaaagcccgggtattcgacgactcattcagcaacaagacgttggctttcaaagagttcaacataaagaaaggcgaaagcacggcattcgactatatcacctccctcaactgcgaaggcgaactaaaccaatatctcacgcgagtcgaaaacgcatacaaaacaaaatcgatctccctaacgaagtacaaaaacctcctcaagaaagcgtcggaaataggagacggcttcatcaaccgagacctccgagacactcaatacatcgccaaaaaggcaaaagaaatactctttcaagtcacgaagaacgtactgtctacatcgggtagcatcacagaccgcctcagagaagattggggactggtcgacgtaatgaaggaactgaacatgccgaagtaccagagcttgggccttacagaggtagaggaacgcaaggacggcaacaaagtcaccgtcatcaaagactggacaaagcgtaatgaccaccgccaccatgcaatggacgcacttaccgtcgcctttaccaaacccagctatatccaatatttgaaccacctgaacgcccggaaagacgaaaacaacaagaactacagcgtcatcctcgcaatagagaagaaagaaaccataaaagtacccatcaacaacggtaaaaacaagagagtcttcatagaacccatactcaacttccgccaagtagctaaaaagcacttggaagaaattttcatctcacacaaggcaaagaataaagtcgtcaccaaaaacatcaacaaacccgcaggcaccgacaagcagcaaataacactgacaccacgcggtcaactccacaaggagaccatctacggaaagtatcaatactacgtcaacaaggaggaaaaagtcggggtaaaattcgatgagcggacgataaccaaagtctcaaaccccctctaccgcgaagctctgctcaagcgccttcaagccaatgacaacgaccccaagaaagccttcgcaggtaaaaacgcactgtccaaaaaccccatctatctggacgaggccaaaacgaaaaccctcccggaaaaagtaaatctaacctacctggaagaagacttcagcataaggaaggatatcagccccgacaatttcaaggacctaaaaagcatagaaaaagtgatcgaccaaggagtaaaacgcatactgattaagagactccaagcgtatgacaacgaccctaaaaaggccttcgtcgacctagagaaaaacccaatctggttgaacaaggaaaaaggcatcgccatcaaacgcgtcaccatctccggcgtcagcaacgcgcaaccacttcacataggcaaagaccaccttggtaaaaccacgttaaacaaagaaggcaaggaggtacccgtagactacgttagcacaggcaacaatcaccacgtcgctatctaccgggacaaggaagggaatctacaagaacagatagtatccttcttcgaagcagtggtacgggcccagcagggcctgcctattatagacaagaactacaagcaagccgaagggtggcagttcatgttcaccatgaaacaaaacgaaatgttcgtgttcccgaacgaagccacgggcttcaacccggccgagatcgatctacttgatccaaagaacaagaaactcatctctccaaacctcttccgagtccagacaatctccattgtaaagtatggaaactccgtcgtacgggacttcaagttcaggcaccatctcgaaacaacactccaagacgacaaaatcttacaaggcataacatttcaacagataaaatcactcgaaccactgaggaacatagtcaaggtgcgcataaaccacctaggggacatagtcaatatcggggagtattga

SEQ ID NO: 6838 - RNA, 4311 nt, synthetic construct
  misc_feature 1..4311: note = Cas9 variant
  source 1..4311: mol_type = other RNA
atgaaacgcattctaggcctcgacctcggaacgaactcaataggatgggccctagtcaacgaagcagagaacaaggacgagcgatcgagcatcgtcaagctcggcgtacgagtaaaccccttaaccgtcgacgagctaacaaacttcgagaagggcaaaagcataacaacaaacgcggacagaaccctcaaacgcggaatgagaaggaatctacaacgatataagctccgacgcgaaacactcacggaggtgcttaaagaacacaagctcataaccgaagacaccatcctgtcagagaacgggaaccgcaccaccttcgagacctaccgactacgagcgaaagcagtaaccgaagaaatctcgctcgaagaatttgcacgagttctactcatgataaacaaaaagcgaggatacaaatcaagcagaaaggccaaaggcgtggaggaaggcacgctcatcgatggcatggacatagcccgagagctctacaacaacaatctcacccctggagagctatgtttacaactactcgacgcaggcaagaagttcctgcccgatttctaccggagtgatctgcaaaatgaactcgatcgtatctgggagaaacaaaaagaatactacccagagatactcaccgatgtattgaaggaagaactccgaggtaagaaacgcgacgccgtatgggcaatctgcgcaaaatacttcgtctggaaagagaactacaccgagtggaacaaggagaaaggaaagacggaacaacaagaaagagaacacaaacttgagggaatctacagcaagcgcaagcgcgacgaagcaaagcgagaaaacctccaatggcgagtgaacggactcaaagagaagctctccctcgagcagctagtaatcgtcttccaagaaatgaacacgcaaatcaacaacagctctggatacctgggcgcaatcagcgatcgatctaaggaactatacttcaacaaacagacagtaggacaatatcaaatggaaatgctagacaaaaatcctaacgcttcgctaagaaatatggtattttaccgccaagactatctagacgagttcaacatgctctgggagaaacaagcagtctaccacaaggagctcaccgaggaactcaaaaaggaaatcagagacatcataatattttaccagagacgactaaaaagccaaaaaggcctaataggcttctgcgagttcgaatcccgccagatcgaagtggacatagatggcaaaaagaagataaaaacggtcggaaaccgggtcatatcgcggtcctccccactattccaggagttcaagatttggcaaatcctaaacaacatcgaggtaacagtcgtgggcaagaaacggaagagacgaaaactaaaagaaaactacagcgcattatttgaggaactaaacgacgccgaacaactcgaactcaacggcagcagacgactatgtcaagaagagaaagaactgctcgcccaggaactgttcgtccgagataagatgacaaaaagcgaggtactaaagctactgttcgacaacccgcaagagctcgacctcaacttcaaaacaatagacggcaacaaaactggatacgccctgttccaggcatactcgaagatgatagaaatgtccggacacgaacccgtagacttcaagaaaccagtggaaaaagtggtcgagtacattaaagcagtcttcgacttgctaaactggaacactgacatcttaggatttaacagcaacgaggaactcgacaaccagtcctactacaaactgtggcatctgctgtacagcttcgaaggcgacaatacccccacggggaacgggcggctaatacagaaaatgaccgaactgtacgggttcgagaaggagtatgcaacaatactagcaaacgtctccttccaagacgactacggcagcctgtccgcgaaggccatacacaagatactaccccacctaaaggagggtaaccgatacgacgtggcatgcgtctacgccgggtaccggcacagcgaatcatctctaacacgcgaagagattgccaacaaagtgctgaaagatcggctaatgctcctacccaagaacagcttacacaacccagtcgtcgagaaaatactcaaccagatggtaaacgtaattaacgtcataatagacatatacgggaaaccagacgaaatccgggtagaactcgcccgggaactcaagaagaacgcaaaggagcgcgaagagttaacaaagtccatcgcgcagacaaccaaagcacacgaagagtataaaacactcctacaaacggaatttggattaaccaacgtatcccgcacggatatactgcggtacaaactatacaaagaactagaatcctgtggatacaaaacgctgtactcaaacacctacatctcacgtgagaaacttttctccaaagagttcgatatcgagcacatcatcccccaagcccggctgttcgacgactccttttccaataaaacactcgaagcgcgaagcgtcaacatagaaaaaggaaacaacaccgcgtacgacttcgtcaaggagaaatttggagaatcaggcgccgacaacagtctggagcaatacctgaacaacattgaggacctcttcaagagcggcaaaataagtaaaaccaaatataacaaattgaagatggctgaacaagacattcctgacggcttcatcgagcgtgacttgcgcaacacgcaatacatagcaaagaaagcgttatcaatgctcaatgaaatcagccaccgcgtggtcgccacatcagggtcagtaacggacaaactgcgcgaagactggcaactgattgacgtaatgaaagaactcaactgggagaaatacaaagccttaggcctagtcgagtatttcgaagaccgagacgggcggcagataggacgcattaaagattggacgaaacgcaacgaccaccggcaccacgcgatggacgcactgactgtcgccttcaccaaggacgtgttcatccaatatttcaacaacaagaatgcatcgctagacccaaacgccaacgagcacgcaataaagaacaaatacttccaaaacggccgggcaatagccccaatgccgctgcgagaatttagggcagaagccaagaaacacctcgaaaacacactcatctccatcaaagcaaagaacaaagtaataactggcaacatcaacaaaaccaggaagaaaggaggggtaaacaaaaacatgcaacagacccccaggggccagctacacctcgaaacaatttacgggagcggtaaacaatacctaacaaaagaagaaaaagtgaacgcgagcttcgatatgagaaaaatcggcacagtatcaaaaagcgcctacagagacgcgctcctaaaaaggctgtacgaaaatgacaacgacccaaagaaagcgttcgcggggaaaaatagtctcgacaaacagccgatctggctcgataaagagcaaatgcgaaaagtaccggagaaagttaaaatcgtcacgctagaggcgatctacaccatacggaaagaaataagccctgacctaaaagtcgataaagtcatcgacgtcggagtacggaaaatactcatcgaccggctaaatgagtacggaaacgacgcgaagaaggcgttcagcaacctggacgagaaccccatatggctaaacaaagaaaagggcatctcgatcaaacgagtcaccatctcaggcatcagcaacgcgcaatccctccatgtgaaaaaggacaaagacggaaaaccaatcctcgacgagaatggccgcaacatacctgtcgacttcgtgaataccggaaacaatcatcatgtcgctgtatactaccgccccgtaatagacaaaagaggacagctagtggtagacgaggcaggcaaccccaaatacgagctcgaagaggtagtcgtgtcatttttcgaggcggtcactcgagctaatctagggcaaccgataatagataaggactataagaccaccgaaggctggcaattcctattctccatgaaacaaaatgaatacttcgtattccccaacgaaaagaccggcttcaatccaaaagaaattgatctactagacgtagaaaactacggactaatcagcccgaaccttttccgtgtccaaaagttctccctgaaaaactacgtgttccggcatcacctggagaccacaatcaaagacactagctccatcctccgagggataacgtggatcgacttcagaagctcgaaagggctggacacaatagtcaaagtcagggtcaaccatatcggccaaatcgtaagcgtcggcgagtactga

SEQ ID NO: 6839 - RNA, 4311 nt, synthetic construct
  misc_feature 1..4311: note = Cas9 variant
  source 1..4311: mol_type = other RNA
atgaaaaggatactagggctagacctcggaacgaacagtatcggctgggccctcgtgaatgaagcagagaacaaagacgaacgaagcagtatagtcaaactaggagtcagagtcaaccccctgacggtagacgagttaacgaacttcgaaaagggaaagagcataaccaccaacgccgaccgcacattaaaacgaggcatgagacggaacctccaacgctacaaactcaggcgagaaaccctgaccgaagtcctaaaagaacataaactcatcacggaagacaccatcctgtccgaaaacgggaaccgcacaaccttcgaaacatatagactccgcgcaaaagcggtcaccgaggaaatctcgctggaggagttcgcccgggtcctcctcatgataaacaagaagcgaggctataaaagctcacggaaagctaaaggagtcgaagaaggaacattgatagacggtatggacattgcacgagaactatacaacaacaacctgacaccaggagaactctgcctacaactgctggatgccgggaagaaattcttgccagacttctaccgaagcgacctacaaaatgaactcgaccgcatctgggaaaaacaaaaggagtactatccagagatattgacggacgtactgaaggaggaactgcgaggcaagaagagagacgcggtctgggccatctgtgcaaagtattttgtctggaaagaaaactacacggagtggaacaaagagaaaggaaaaacggaacaacaggaacgggaacacaagctagagggcatctactcgaaacgaaagcgcgacgaagcgaaacgcgagaacctgcaatggcgcgtgaatgggctcaaggaaaaactcagcctcgaacaactggtaatagtttttcaagaaatgaacacccaaataaacaactcaagcggctacctgggcgcgatctccgaccgcagtaaggagctatacttcaacaaacaaacggtagggcaataccaaatggaaatgctagacaaaaacccaaacgcatcactccgcaacatggtattctaccgccaggactacctcgacgagttcaatatgctctgggaaaaacaggccgtgtaccacaaggaactcacggaggaactcaaaaaggaaataagggacataatcattttctaccagcggcgactcaaaagccaaaaagggctcatcggtttctgtgagttcgaatcccgacaaatcgaggtcgacatagatgggaagaagaaaatcaaaacggtggggaacagagtaatatctcgtagcagcccactgttccaggagttcaagatctggcaaatcctcaacaatatagaagtaaccgtagtaggcaaaaagcgaaaacgcagaaaactcaaagagaattactctgccctgttcgaggagctaaacgacgcagagcaactagagttgaacggaagccgccggttgtgccaagaggagaaggaactcctcgcacaggaacttttcatccgcgacaaaatgaccaaaagcgaagtgctcaaactcttgttcgataacccacaggagctcgacctcaacttcaaaacaatagacggaaacaaaacagggtacgcgctgtttcaggcgtacagcaaaatgatagaaatgagtggccacgagcccgtcgatttcaaaaagcccgtcgagaaagtcgtagaatacatcaaagccgtgttcgatctcctcaactggaacacggacatactgggctttaactcaaacgaagaactcgacaaccagccatactacaaactatggcacctcctgtactccttcgaaggcgacaacacaccaacaggcaatggacgtctcatccagaaaatgacagagctctacggcttcgaaaaagagtacgcgaccatcctcgcaaacgtgagcttccaagacgactacggatcgctatccgcgaaagccatccacaaaattctcccacacttaaaggaaggtaacagatacgatgtcgcatgcgtatacgccggctaccgacactccgaatcatcgctaaccagagaggaaatcgccaacaaagtgctcaaagaccggcttatgctcctaccgaagaacagcctacacaacccggtggtggagaaaatactaaaccaaatggtcaacgtaataaacgtcatcatcgacatatatggcaagccagacgaaatccgagtcgaactagctcgagaactgaagaagaacgcaaaggagcgtgaagaactgacaaaaagcatcgcccaaaccaccaaagcacacgaagaatacaaaaccctattacaaactgagttcggcctcacaaatgtatcccgcaccgatatcctgcgctacaagctgtataaagaactcgaaagctgcggctacaagaccctgtatagcaatacctatatctcaagggaaaagctgttctcaaaagagttcgacatcgagcacatcatcccccaagcacgactttttgacgacagcttcagcaacaagacactcgaagcccgctccgtcaacatcgagaaggggaataaaaccgcgtacgacttcgtaaaggagaaattcggggagagcggtgccgacaacagcctagagcactacctcaacaacatagaggaccttttcaaatcagggaagataagtaaaacgaagtacaacaagttaaaaatggcggaacaggatatcccagacggattcatcgagcgcgatttacgaaacacgcaatatatagccaaaaaggcactaagcatgctcaacgaaatcagccaccgcgtagtagcgaccagcggaagtgtgacagataaactccgcgaagactggcagctcatcgacgtgatgaaagaactgaactgggaaaaatacaaggccctgggccttgtggagtacttcgaagaccgtgacgggcggcaaatcgggagaataaaagattggaccaagcgaaatgaccaccgccaccacgcgatggacgcgctcacagtcgcctttacaaaggacgtcttcattcaatatttcaacaacaagaacgcaagcctagacccaaacgcaaatgagcacgcaataaagaacaaatacttccaaaacggcagggccattgcccccatgcccctacgggaatttagggccgaagccaagaaacacctagagaataccctaataagcataaaggcgaaaaacaaggtcattacaggaaatatcaacaaaacccgcaagaaaggcggcgtgaacaagaacatgcaacaaaccccgcgaggacagctccacctggagaccatatacggcagcggaaagcagtacctgacgaaggaagaaaaagtcaacgccagctttgacatgagaaaaatagggaccgtatccaaaagcgcataccgagacgccctattaaaacgactctacgaaaacgacaacgacccgaagaaggcgttcgcagggaaaaacagcctagacaagcaaccaatatggctcgacaaagagcagatgcggaaagtcccagaaaaagtgaaaatcgttaccctagaggccatctacacaatccgaaaagaaataagtcctgaccttaaagtagacaaggtgatcgacgtaggcgtccgcaagatcctcattgaccgactgaacgaatacgggaacgacgccaagaaagcattctcgaacctcgataaaaacccaatatggctgaacaaagagaaaggaatcagcataaaaagagtaacaatatcaggcatctcgaacgcgcagtcactacacgtcaagaaagataaagacggaaaacccatacttgacgagaatggccggaatatacccgtcgatttcgtcaacaccggcaacaaccatcacgtagcagtttattaccgcccggtgatagacaaacgcggacaactggtagtcgacgaagccggcaacccgaaatacgaactcgaagaagtagtcgtatccttcttcgaagcggtgaccagagcgaacctgggcctgccaataatcgacaaagactacaaaacaacagaaggctggcaattcctcttcagcatgaagcagaacgagtactttgtgttccccaatgaaaagacaggattcaaccccaaagaaatagaccttctggacgtcgaaaactacggcctcataagcccgaatctcttccgggtgcaaaagttcagcctgaaaaactacgtattccggcaccacctagagacgaccatcaaagatacctccagcatactaaggggcatcacctggatcgatttcagatctagcaaaggactagatacgatagtcaaagtcagagttaaccacatcgggcagatagtctcggtcggcgaatactga

SEQ ID NO: 6840 - RNA, 4311 nt, synthetic construct
  misc_feature 1..4311: note = Cas9 variant
  source 1..4311: mol_type = other RNA
atgaaacgaatactaggcctcgacctaggtaccaacagcattgggtgggccttggtgaacgaggccgaaaacaaagacgaacgatcaagcatagtaaagctgggcgtcagagtgaacccgctcacagtcgacgagctcaccaacttcgaaaaaggaaaaagcatcaccaccaacgccgacagaacactaaaaagaggcatgagacgaaacctccaacggtacaaactacggcgagaaacgctcacagaagtccttaaagagcataagctcatcaccgaggacacgatcctatcagagaacggaaataggaccacctttgaaacataccgacttcgagccaaagccgtaactgaggagatctctctagaagagttcgcccgggtactgcttatgatcaacaaaaagcgaggatataaaagctcccgcaaggcaaagggggtcgaagaaggaaccctgatagacggaatggacatcgcccgagaactctacaacaacaacctaacccccggggaactctgccttcagctgctcgacgcaggcaagaagttcctcccagacttctaccgaagtgacctacagaacgaattagacaggatctgggaaaaacaaaaggaatactatcctgaaatcctcacggacgtactaaaggaagaactccgcggcaagaaacgagacgcagtgtgggcgatatgtgccaaatacttcgtctggaaagaaaactacacagaatggaataaggaaaaaggtaaaacagaacaacaagaaagagaacacaaactggagggaatatactccaaaagaaagcgggacgaagcaaagcgcgagaatctacagtggcgcgtcaacggcctaaaagagaaactctccctcgagcagctcgtcatcgtcttccaggaaatgaatacccagataaacaactcgagcggctacctaggcgccatatcagaccgatccaaagaattgtacttcaataagcaaaccgtcggccagtaccagatggaaatgcttgacaaaaaccccaacgcaagcctacggaacatggtcttctaccggcaagactacctcgacgagttcaatatgctctgggaaaaacaggccgtctaccacaaagagcttaccgaagaattgaagaaagagatccgagacatcattatcttctatcaacgacgtctgaagtcacagaaaggtctcatcggcttctgcgagttcgagtcgcgacagatcgaggtcgacatcgacggcaaaaagaaaattaaaacagtgggaaaccgcgttatctcccgatcatcacccctctttcaggagttcaaaatctggcaaatactgaacaacatagaagtgaccgttgtcggaaagaaacgtaaacgacgaaaacttaaggaaaactacagcgcgctgttcgaagaacttaacgacgcagaacaactagaactaaacggcagccgaagactttgccaggaagaaaaggaactcctagcccaagaactcttcatccgagacaaaatgaccaaaagcgaagtactcaaactcctcttcgacaacccgcaggagctagacctgaatttcaaaacaatagacgggaacaaaaccggctacgcactcttccaagcatactccaaaatgatagaaatgagcggacacgaaccggtcgatttcaaaaagcccgtagagaaagtcgtcgagtatataaaagccgtattcgacctactgaactggaacacggatatcctcgggttcaactcgaacgaagaactggacaaccaaagctactataagctatggcatctgctatactccttcgagggcgataatacaccgacgggaaacggaaggctaatacaaaagatgaccgagctatacggcttcgagaaagagtacgccaccatcctcgcgaacgtatcctttcaagacgactacggctcactcagcgccaaagccatccacaaaatcctccctcacctcaaggagggcaaccgatacgacgtggcatgtgtgtacgcaggataccggcacagcgagagcagcctcacccgcgaagaaatcgcaaataaagtgctaaaagaccgactgatgctcctaccgaaaaactcgctccacaacccagtagtcgagaaaatactcaaccaaatggtaaacgtaattaacgttatcatagatatatatggcaagccagatgaaatccgagtcgaactcgcgcgcgagcttaagaaaaatgccaaagaacgagaggaattaaccaagtctatcgcccagacaacaaaagcccacgaagaatacaagacactcctacagaccgagttcggactaacaaacgtcagccgaacggacatccttcgctacaaactctataaagagctagagagctgcggctacaaaacactctactccaacacatacatctcacgggagaaactgttttcaaaagagttcgatatcgagcacatcatcccccaagcgcgactcttcgatgacagcttcagcaacaagacactcgaagcacgcagcgtcaacatcgagaaagggaacaaaacagcctacgacttcgtgaaggaaaagttcggggaatcaggcgccgacaacagcctagaacactacctcaacaacatcgaagacctcttcaagtccggaaagatcagcaagacgaagtacaacaaactcaagatggcagagcaagacatcccagacggcttcatcgaacgcgacctccgaaacacccagtatatcgcgaagaaagcgctcagcatgctaaacgaaatatcgcaccgtgtcgttgccacgagcggatccgtgacggacaaactcagggaagactggcaattaatcgatgtgatgaaagaactgaactgggaaaaatacaaggcactagggctcgtggagtacttcgaagaccgagacggccgccagatcggcagaattaaagactggaccaaacgcaacgaccatcgccaccacgcaatggacgcactcacggtcgcttttaccaaagatgtgttcatacaatacttcaacaacaagaatgcaagcctagacccgaacgcaaacgaacacgcgatcaaaaacaagtacttccagaacggtcgagcaatagccccaatgcccctacgcgagttccgcgccgaggccaagaagcacctagaaaataccctcataagtataaaggctaagaacaaagtcataacaggaaacataaacaaaaccaggaagaaaggcggcgtgaacaaaaatatgcagcaaacaccgagaggccaattacatctcgagacaatctacgggtcgggcaagcaatacttgaccaaggaagagaaagtaaacgcttcattcgacatgagaaagataggaacagtatccaaactggcataccgggacgcactactcaaacgactctacgagaacgacaatgacccaaagaaggccttcgcagggaaaaatagcctcgacaaacagccaatctggctggacaaagaacagatgcgaaaagtaccagaaaaagtcaaaatagtgacactggaagcgatctacacaatacgaaaggagatatcccccgacctcaaggtcgacaaagtaatcgatgtaggagtaagaaaaatcctcatcgaccgactcaatgaatacggcaatgacgccaagaaagcattttccaacctcgatgagaatccgatctggctaaacaaagagaaaggaatcagcatcaaacgcgtgaccataagcggtatatccaacgcccaaagcctgcacgtcaaaaaggacaaggacggaaaaccgatcctcgacgaaaacggccgcaacatcccagtcgactttgtgaacactggcaacaaccatcacgtagcagtctactacagaccggtgatcgacaagcgcggacagctagtcgtagatgaagccgggaacccaaaatacgaactagaggaagtggtagtctcattcttcgaagccgtaacgagggcaaacctgggccaaccaataatagacaaggactataaaaccaccgaaggatggcaattcctattcagcatgaagcaaaacgagtactttgtattccccaacgagaaaaccggcttcaaccccaaagaaatagacctgctcgacgtagaaaactacggcctcatttcccccaacctgttcagggtccagaaattctcactcaaaaactatgttttcagacaccacctagagacaaccataaaggacacaagctccatactccgcggcattacctggatcgatttcaggtcatcgaaaggccttgacacaatcgtgaaggtacgggtgaaccacatcggacaaatcgtcagcgtcggagagtactga

SEQ ID NO: 6841 - RNA, 4311 nt, synthetic construct
  misc_feature 1..4311: note = Cas9 variant
  source 1..4311: mol_type = other RNA
atgaagaggattctgggcctcgacctgggaaccaattctatcgggtgggctctcgtaaatgaagcggaaaacaaggacgaacgctcatccatcgtcaagctcggagtgagggtcaaccccctaaccgtcgacgaactgacgaacttcgaaaagggaaaaagtatcaccacgaacgcggaccgcacactgaaacgaggcatgcgccgcaacctgcagcgatacaaactaaggcgcgaaaccctaacggaggtcctaaaagaacacaagttaataaccgaggacaccatactatcagaaaacggtaaccgaactacattcgagacgtatagattacgagccaaagcggtgacagaagagatcagcctggaagagttcgccagagtactgctgatgataaacaagaaacggggctacaagtcaagccgcaaagcaaaaggcgtagaagagggcacactgattgacgggatggacatagcaagagaactctacaacaacaacctcacccccggagagctctgcctccagctcctcgacgcgggcaagaaattcctccccgacttctacagaagcgatcttcagaacgaactcgaccggatatgggagaagcaaaaggagtactacccggagatcctaacagacgtattaaaagaggaactacgcggcaagaaacgggacgccgtgtgggcgatctgcgcgaaatacttcgtttggaaagagacttacacggagtggaataaagagaaaggcaaaaccgagcagcaagagagagaacacaaacttgaaggcatctacagcaagaggaagagagacgaggcaaaacgagaaaacctgcaatggcgggtaaacggactgaaagaaaaactgtcgctcgaacagctagttatagtattccaagagatgaacacccaaatcaacaacagctcaggctacctaggcgcgataagcgacaggagcaaagaactctacttcaacaaacaaacggtcggccaataccagatggagatgcttgacaagaacccaaatgcgagtctgcgcaacatggtcttctacagacaagattacctagacgagttcaacatgctgtgggaaaaacaagcagtctaccacaaggaactaactgaagaactaaagaaggaaatccgagacataattatcttctatcaaaggcggctgaaaagccaaaagggtttaatcggattctgcgaatttgagtctcgtcaaatcgaagtcgacatcgacggaaagaaaaagataaagacggtcggcaaccgcgttatatcccgatcaagcccactgttccaggagttcaaaatatggcaaatactcaacaatatcgaagtcacagtagtgggcaagaagagaaagagaagaaaactaaaagaaaactacagcgcaattttcgaggagctcaacgacgcggaacaactcgagctgaacggatcacgaaggctctgccaggaggagaaggaactgctcgcgcaagaactcttcgtacgcgacaaaatgacgaaaagcgaagtactcaaactcctattcgacaacccccaagaactagaccttaacttcaaaacaattgacgggaacaagacagggtacgcgctgtttcaagcatactccaaaatgatagaaatgtcaggccacgaacccgtcgacttcaaaaagccagttgagaaagttgtcgagtacatcaaagcagtcttcgaccttctaaattggaacacagacatcctagggttcaactccaacgaagaattagacaaccaaagctactacaaactctggcacctcctctactcctttgagggcgacaacacgcccacaggcaacggcagattgatacagaaaatgacagagttatacggcttcgaaaaggaatacgccaccatcttggcaaacgtgagctttcaagacgactacgggtccctcagcgcaaaggccatccacaaaatcctaccccacttaaaggaaggaaacagatacgacgtggcgtgcgtatatgccggataccggcactcagaatccagcctaaccagggaagagatcgcaaacaaggtcctcaaggacagactcatgctactccccaaaaacagcctacacaatccagtcgtagagaaaatactgaaccagatggtgaacgtcatcaacgtcataatagacatttacggcaagccggacgaaatccgagtcgaactggcccgcgagctaaagaagaacgccaaagaaagagaggaactaaccaaaagcatcgcgcagaccacaaaagcaaacgaggagtacaaaaccctcctccaaaccgagttcgggctcacaaacgtctcccgcactgacatactacgctacaagctctataaggagttagaaagctgcggctacaaaacgctttacagcaatacctacatctcgcgggagaaactcttctcgaaagagttcgacatcgaacacatcataccacaagcccgcctgtttgacgatagcttctcaaacaaaactctggaagcccggtcagtgaacatcgaaaaagggaataagacagcctacgacttcgtcaaagaaaagttcggggagagcggcgcggacaattcgcttgagcactatctaaacaacattgaagacctcttcaaatcagggaagataagcaaaactaagtacaacaaactcaaaatggctaaacaagacattcccgacggcttcatagaacgcgacctgcggaacacccaatacatagccaagaaagcccttagcatgctcaacgaaatctcccatcgcgtcgtcgcgacctcggggagcgtaaccgataaactccgagaagattggcaactcatcgatgttatgaaagaactcaactgggaaaaatacaaagcgttggggctagtagagtacttcgaagacagagacggacggcaaatcggacggataaaagattggactaagcgaaacgaccatcgacatcatgcaatggacgccctgactgtagcctttaccaaagacgtcttcatacaatacttcaacaacaagaacgcatcactcgacccgaacgcgaacgaacacgctatcaagaacaaatacttccaaaacggacgggccatagccccgatgccattaagagagttccgcgctgaagctaagaaacacctagaaaacacactaatatctatcaaagctaaaaacaaggtgatcacagggaacatcaataagacgcggaagaaaggcggagtaaataaaaacatgcagcagacgccacggggccaactgcacctagaaacgatctacggatcagggaaacagtacctcacaaaagaagaacgcgtcaacgccagcttcgacatgagaaagatagaaaccgtgtcgaaatccgcctaccgagatgccctgctaaaacgcctgtacgaaaacgacaacgacccgaaaaaggccttcgcaggcaaaaattcactcgacaagcaaccaatctggctagacaaggaacagaagcggaaagtaccggaaaaagtcaagattgtaaccctcgaagccatatacacgattcggaaggaaataagtcccgacctcaaagtagacaaggttatagacgttggcgtaagaaagatcctaatcgacaggctgaatgaatacggcaacgacgcgaagaaagcattctccaacctcgacgagaacccgatttggctgaacaaagaaaaagggataagtatcaagcgcgtcacaataagcggaatctcaaacgcccaatctctccacgtgaagaaagacaaagacggcaagccaattctagacgaaaacggaagaaacattccggtagactttgtcaacaccggaaataaccaccacgtcgcggtctactaccgccccgtgatagacaagcgagggcaattggtagtagacgaagcagggaaccccaaatacgaactcgaagaggtagtcgtcagctttttcgaagcagtcacccgggccaacctcgggcagccgatcatagacaaagactacaaaaccacggaaggctggcagtttctcttcagcatgaaacaaaatgagtacttcgtattcccaaacgagaaaaccgggttcaaccccaaggaaatcgacctacttgacgtggaaaattacggcctaatctcaccgaatctattccgggtacaaaaattctctctcaaaaactacgttttccgccaccacctagaaacaaccataaaagacacctcctcaatcctacgagggatcacctggatagacttcagaagcagcaaagggctagacaccatcgtaaaagtgagagtaaaccacatcggccagatcgtttcagtcggcgaatactga

SEQ ID NO: 6842 - RNA, 4311 nt, synthetic construct
  misc_feature 1..4311: note = Cas9 variant
  source 1..4311: mol_type = other RNA
atgaaacgaatcctcggactagacctcggcacaaactccataggctgggccctcgtcaatgaggcagagaacaaggacgagcgtagctccatcgtaaagctcggtgtcagagttaaccctctaaccgtcgacgaactaacgaactttgaaaagggcaagagcataacaaccaacgctgaccggacgcttaagcggggcatgcgccgaaacctccagagatacaaactgcggcgcgagacactcaccgaggtccttaaggaacacaaacttatcacagaagacacaatcctatcagaaaacgggaacaggacgacgttcgaaacctaccggctccgcgcaaaggctgtcacggaagagataagccttgaagagtttgctagggtacttcttatgatcaacaagaaacgcggctacaagagctcgcgcaaagcaaagggagtcgaagaaggaacgctaatcgacggcatggacatcgcgcgcgagctgtataataacaacctcacgcccggagagctctgcctacaactactcgatgcaggcaagaaattcctgccggacttctaccgcagcgacctacagaacgaactagaccgcatttgggagaaacaaaaagaatactatcccgagatcctcaccgacgtattgaaagaagaactacgagggaagaaacgagacgccgtatgggccatctgcgcgaagtactttgtctggaaggaaacctacacggaatggaacaaagaaaaagggaaaaccgagcagcaggagaaagaacacaaactcgaaggcatctacagcaagaggaaacgggacgaagcaaaacgcgagaacctacaatggcgagtgaacggactgaaggaaaaactatcactggagcagctagtaatagtgttccaagaaatgaacacacagatcaacaacagcagcggctatctaggagcaatcagcgacaggtccaaagagctctacttcaataagcagacagtaggccaataccagatggaaatgcttgataaaaatccgaacgcgtccctccgcaacatggtattttaccgacaggactatctggacgagttcaatatgctgtgggaaaaacaagcggtgtatcacaaagaactcactgaagaattaaagaaagagatacgcgacatcatcatattctaccaacgacggctaaagagtcagaagggcctcattgggttctgtgaatttgagtcgagacaaatcgaggtagatatagacggcaaaaagaaaatcaaaaccgtcggtaaccgcgtgatatcccgatcaagccctctcttccaagagttcaagatctggcaaatactcaacaacatagaagtgacagtggtgggaaagaaaagaaaaaggcgcaaattaaaagagaactacagcgcactatttgaggaactcaatgacgcagaacagctcgagctcaacggcagtcggcgcctgtgccaagaagaaaaggaattattagcccaagagttattcatcagagacaagatgaccaaaagtgaagttctaaaactgctgttcgacaacccccaggaactagatctgaacttcaagaccatagacgggaacaaaactggatacgcactcttccaagcgtactcgaagatgatcgagatgagtggacacgagccggtcgactttaaaaagccggtcgaaaaggtcgtcgaatacataaaagcggtgttcgacctacttaactggaacacagacatactcggattcaactcaaacgaagaactagacaaccaatcgtattacaaactctggcaccttctctatagcttcgagggagacaacaccccaaccggaaacggtcgactgatccagaagatgaccgagctatacgggttcgagaaggaatacgcaacaatattagccaacgtcagcttccaggacgactacggatcgctcagcgcaaaggcaatccacaaaatcctcccccacctcaaagaaggcaacaggtacgacgtagcctgcgtgtacgccggctaccgccactccgaaagttccctaacgcgcgaggagatcgccaacaaagtactaaaagaccggcttatgctcctccccaagaactcactccataaccctgtcgtcgaaaagatattaaaccagatggttaacgtaatcaacgtgataatcgacatctacggcaagcctgacgaaataagagtcgaactagcccgagagctaaagaaaaacgccaaagaacgagaggagctaactaaatccatagcacaaacaaccaaggcacacgaagaatataaaacactcctccaaacggagttcggcctgactaacgtctcacgtaccgacatactcaggtacaagttgtacaaagaactcgaatcatgcggctataaaacgctatactcaaatacgtacataagtcgagagaaactttttagcaaagagttcgacatagaacacatcataccgcaagcccgactattcgatgacagcttttccaacaaaaccctcgaagcgcgaagcgtcaacatcgagaaaggaaacaagacggcatacgacttcgtcaaagaaaagttcggcgaaagtggcgccgacaacagcctagagcactacctcaacaacattgaggatctattcaaatcgggcaaaatcagcaagacaaaatacaacaagctcaaaatggccgaacaagatataccagacgggttcatagagcgagacctacgcaacacgcagtatatcgcgaagaaagccctaagcatgctaaacgaaatcagtcaccgcgtcgtagccacctccggatcagtcacagacaaactccgcgaggattggcagcttatagacgtgatgaaagaactgaactgggaaaaatacaaggcgctcggcctagtagagtacttcgaggaccgcgacggcaggcaaatcggccggataaaggactggaccaaacgcaacgaccacagacatcacgcaatggacgcactcacggttgctttcacaaaggacgtattcatacaatacttcaacaacaaaaacgccagcctcgacccaaacgcaaacgaacatgccatcaagaacaagtatttccaaaacggtcgcgctattgcgcccatgccactgcgagagttcagggcagaagcaaagaaacatctagagaacacgctcatttcgatcaaagcgaaaaataaagtcatcacgggcaacataaacaagacgcgtaagaaagggggagtcaacaaaaacatgcagcaaactccccgaggccaactgcacctagaaaccatctacggctccggcaaacaatacctcaccaaggaagagaaagtgaatgcgtccttcgacatgcggaaaatcgggactgtgagtaaactcgcgtatcgcgacgcccttttgaaacgcctctacgaaaacgacaacgaccccaaaaaggcattcgcgggcaaaaactcactagacaaacaaccgatatggctagataaagagcaaatgagaaaggttccagaaaaagtcaaaatcgtgaccctcgaagcaatatacacgatccgcaaggaaatctccccagacttaaaagtcgacaaagtaatagacgtaggtgtccgaaagatcctaatagaccgcctcaacgaatacggaaacgatgccaagaaagcgttcagcaacctagacgagaaccccatctggctgaataaagaaaaagggatctcaataaaacgagtcactataagcgggatctcaaacgctcagagtctccacgtcaagaaagacaaagacggcaaacccatcttagacgaaaatggccgcaacatcccagtagacttcgtaaacacaggaaacaaccaccacgtcgctgtatactacagaccggtaatcgacaaacggggacagctagttgtagacgaagctggcaaccccaaatacgaactagaagaagtagtggtaagtttcttcgaagccgtaacaagggcaaatctcggccaaccaatcatcgacaaagactacaaaacaaccgaagggtggcaatttctattctccatgaagcagaacgaatacttcgtcttccccaacgagaaaaccggcttcaatccaaaagagatagatctcctcgacgtagagaactacggattaataagccccaacctcttccgggtccagaaattcagcctcaaaaactatgtcttccgccaccatctcgaaacaaccatcaaagacaccagtagcatactccggggcataacctggatcgacttcaggagcagcaaagggcttgacacaattgtgaaggtcagggtcaatcacattggtcaaatagtgtcagtcggggagtactga

SEQ ID NO: 6843 - RNA, 4311 nt, synthetic construct
  misc_feature 1..4311: note = Cas9 variant
  source 1..4311: mol_type = other RNA
atgaagcgcatactaggcctcgacctaggtacgaacagtatcggatgggccctagtcaatgaagccgagaacaaggacgagcgcagcagtatagttaaactaggcgtccgcgtcaaccccctgacagtcgacgaactcaccaacttcgagaagggtaaaagtatcacgaccaacgcggataggacactaaagagaggcatgagaaggaacctacaacgctacaaactgcgccgggaaaccctcactgaagtactaaaggagcacaagctaattacagaggacacaatactatcagagaatggaaaccgcaccaccttcgaaacctaccgcctgagagccaaagcggtcacagaagaaatatcactagaggagttcgcaagagtacttctaatgattaacaagaaacgtggctacaaatcatcgagaaaggccaagggcgtggaagaaggaacactcatagacggcatggacatagcgagagaactgtacaacaacaacctgacccccggcgagctatgcctacaactcttagacgcgggcaagaagtttctacccgacttctaccgcagtgatctccaaaatgagctggaccgcatctgggagaaacaaaaagaatactacccggaaatactaaccgacgtcctcaaagaggagctgcgaggaaagaagcgcgacgccgtatgggccatctgcgccaagtactttgtctggaaagaaaactacactgagtggaacaaagagaaaggtaagaccgaacaacaagaacgagagcataaactcgaaggcatatactcaaaacgcaaacgtgatgaagcaaagcgcgagaatcttcagtggagagtgaatggactaaaagaaaaactctccctcgaacagctagtcattgtcttccaagaaatgaacacgcaaatcaacaacagtagcgggtacctcggagcaatctccgaccgatccaaggaactctacttcaacaaacaaacggtaggccaataccagatggaaatgctagacaaaaaccctaatgcatcgctgaggaacatggttttctacaggcaggactacctagacgagttcaacatgctgtgggagaaacaggcggtctaccacaaggagttgaccgaagaactgaagaaagaaatacgagacataatcatattctaccaaagaaggctgaaatcacaaaaaggcttaataggcttctgcgagttcgaatcgcggcaaatagaagtcgacatcgacggcaaaaagaaaattaaaacagtcgggaaccgcgtaatttcaagatcatcgccgctattccaagagttcaaaatctggcagatcctcaataacatcgaagtcacggtagtcggcaagaaaagaaaacgcagaaaactgaaggagaactacagcgcactcttcgaagaactcaacgacgcggaacagctagagctcaacggctcaagacggttatgccaagaagaaaaggaactgctcgctcaagaactctttatacgagacaaaatgacgaaatcagaagtgctaaaactcctcttcgacaacccacaggaacttgaccttaacttcaaaacaatcgacggcaacaagaccggttatgcgctattccaagcctacagcaagatgatcgagatgtccggccacgagcccgtcgacttcaagaaacccgtcgagaaagtcgtcgaatacataaaagccgtgttcgacctactaaactggaacactgacatcctcggcttcaacagtaacgaggagctagacaatcaaccctactacaaactttggcacctcctctactcattcgaaggcgacaacacacccaccggaaacggtcgtctgatccagaaaatgacagaactatacggattcgaaaaggaatacgcaacaatcctagccaacgtttccttccaagacgactacggcagcctaagcgcaaaagccatacataaaatactgccacacctcaaggaaggaaaccgatacgacgtcgcctgcgtatacgcaggctaccgccactccgagagctccctcacccgcgaagaaatagcaaataaagtcctcaaagacagactaatgctcctgccaaagaacagtctccataacccggtcgtggagaaaatcctaaaccaaatggtcaacgtcataaacgtcatcatagacatctatgggaaaccagacgaaatacgcgtggaattagccagagaactcaagaaaaatgccaaagaacgcgaggaacttacaaaaagcatagcacaaacaacgaaagcccacgaagaatacaaaacccttctgcaaacagagttcggcctcaccaacgtctcaagaactgacatcctacgctacaagctatacaaagaacttgaaagctgtggatacaagacactctacagcaacacctacatctctcgagaaaaactattctcgaaagagttcgacatcgaacacattataccgcaagcgcgcctgttcgatgacagcttctcaaataaaaccttagaagcgcgtagcgtgaacatagagaagggaaacaaaaccgcctacgacttcgttaaagaaaaattcggcgaatcaggcgccgacaactccctagaacactaccttaacaatatagaagacctcttcaaatcagggaagatctcgaagacaaagtacaacaagctaaagatggcggaacaagacatcccggacgggttcatcgaacgcgacctaagaaacacacaatacatagccaaaaaggcactcagcatgctcaacgaaatcagtcaccgagtcgtcgcaacctcaggaagcgtcaccgataagttacgggaagattggcagctaatcgacgtgatgaaggaactaaactgggagaaatacaaagccctcgggctcgtggagtacttcgaggaccgcgatggccgacagatcggacgcatcaaggactggaccaaacgcaacgaccatagacaccacgcaatggacgccctcaccgtcgcgttcacgaaagacgtattcatccaatacttcaacaacaaaaacgcctccctagaccccaacgcgaacgagcatgccatcaaaaacaagtacttccagaacggcagagcaatagctcccatgcctctgcgggagtttcgcgctgaagcaaagaaacacttagaaaacaccctcatcagcatcaaagctaaaaacaaggtaatcacgggaaacatcaacaaaacccgaaagaaaggaggagttaacaaaaatatgcaacaaacgcctagaggacaactgcacctggaaacaatatacggaagtggtaaacaatacctgaccaaagaagagaaggtcaacgcgagcttcgacatgaggaagattgggacagtaagtaaaagtgcctacagggacgccctcctcaaacgcctatacgaaaacgacaacgacccgaagaaagccttcgccggaaagaactcactcgataaacaacccatctggctcgacaaggaacaaatgagaaaagtaccagaaaaagttaaaatcgtcacccttgaagcgatctacacaatccgcaaagagatatccagcgacctgaaggtcgacaaggtgatcgacgtaggcgtgcggaagatattgatcgatcgcttaaacgagtacgggaacgacgcaaagaaagcgttctcgaacctcgacaagaacccgatctggctcaacaaagagaaaggtatatcaattaaacgagtgactatctcaggcatttcaaacgcacagagcctccacgtcaagaaagacaaagacggaaagcctatccttgacgaaaatggccgaaacattccagtcgactttgtcaacacgggaaataaccatcacgtcgcggtgtactacagacccgtaatcgacaagcggggacagctcgtcgtcgacgaggccggcaatccaaagtacgaactggaggaggtagtggtgagcttcttcgaggcagtaaccagagcaaacctagggctgccaatcatcgacaaggactacaaaaccaccgaaggctggcaattcctattctccatgaaacagaacgaatacttcgtattccccaacgagaaaaccggattcaaccccaaagagattgacctcctcgacgtcgaaaactacggcctcatcagccctaacttattcagggtgcagaagttcagcctaaagaactacgtcttccgacaccacctcgagacgacgatcaaggacactagctccatcctccgcggcattacgtggatcgacttccgcagctcaaaaggacttgacacaatcgtaaaggtcagagtaaaccacataggccaaatagtcagtgtaggagagtattga

SEQ ID NO: 6844 - RNA, 4311 nt, synthetic construct
  misc_feature 1..4311: note = Cas9 variant
  source 1..4311: mol_type = other RNA
atgaagagaatcctcggcctggacctaggcacaaactcgatcggatgggcgctagtcaatgaggccgagaacaaagacgagcgctcctccatcgtgaaactcggcgtacgagtcaaccccctcacagtagacgagctaactaacttcgagaaagggaagtccataaccacgaacgccgaccgaactctaaagagaggaatgcggcggaatctccaaaggtacaaacttcggcgggaaacgctcacagaggtactaaaggaacacaagctgatcacagaggataccatcctcagcgaaaacgggaacagaacaaccttcgagacataccgtctcagagccaaagccgtgactgaagaaatcagcctcgaagagtttgcacgagtactactgatgattaacaagaaacgaggatacaagtcctcacgcaaagccaaaggcgtagaggaaggcacccttatagacggaatggacatcgcccgggagctttacaacaataatctcacgccgggggagctatgcctacaactacttgacgccggcaaaaagtttctccccgacttctaccgatcggacctgcaaaatgaactcgaccggatttgggaaaagcagaaggagtactatccagaaatactgaccgacgtcctaaaagaggaactgcgaggaaagaaacgcgacgctgtctgggccatatgcgccaaatacttcgtgtggaaggagaactacaccgaatggaacaaagaaaaaggcaaaacggagcaacaagaacgagaacacaaactggagggtatctactccaaaagaaaacgggacgaagccaaacgcgagaacttacaatggagagtcaatggcctcaaagaaaagctatccttggaacagctcgtcatagtatttcaagaaatgaacacccaaatcaacaacagttccggatacctcggcgccatatccgacagatcaaaggagctgtacttcaataaacaaacagtgggccagtgccagatggaaatgctcgacaaaaacccaaacgccagcctcagaaacatggtcttctaccggcaagattaccttgacgaatttaatatgctctgggaaaagcaagcggtataccacaaagaactcacagaagaactaaagaaagagatccgagacatcatcatattctatcaacggcgactcaagagccaaaaaggtctaatcggcttctgtgaatttgaatcacgacagatagaagtagacatcgacggcaagaaaaagatcaagacggttgggaacagggtgatctcgagaagcagcccgctattccaagagttcaagatatggcaaatcctcaacaatatagaggtaacagtcgttggaaagaaacggaagcgcaggaagctaaaagagaactactctgccctgttcgaagaacttaacgacgcagaacaactggagcttaacggctcacgtagactctgccaagaggaaaaggaactcctcgcacaagagctgttcatacgagacaaaatgacgaaatccgaagtcctgaagctactcttcgacaacccccaagagctagacctgaacttcaagacaatagacggaaacaagaccggatacgctctcttccaagcctattccaagatgatcgaaatgagcggacacgaaccagtcgacttcaagaaaccggtcgagaaagtagtcgagtacataaaagccgtattcgatctcctgaattggaacacggacatcctcggcttcaactcgaacgaggaactagacaaccaaccttactacaaattatggcatctgctgtactcattcgaaggagacaacacgcccacagggaacggaaggctaatccagaaaatgactgagctgtacggtttcgaaaaagaatacgcaaccatactggcaaacgtatccttccaagacgactacggtagtctcagcgcaaaggccatacacaagatcctaccgcacctaaaagagggcaaccgatacgatgtagcctgcgtgtacgccggctaccggcactccgaatcatctcttacccgggaagaaatcgctaacaaagtgctaaaagacaggctgatgctcctaccgaaaaactcgctccacaacccggtagtcgaaaagatcttaaatcaaatggtcaacgttataaacgtaatcatagacatctacggcaagccagatgaaatccgagtagaactggcacgagagctcaagaaaaatgccaaagagcgcgaagaattaacgaagtccatagcacagacaacgaaggcccacgaggaatataagacactcctgcaaacagagttcggcctcaccaacgtcagcagaaccgacatcctacggtacaaattatataaagaactcgaaagctgcggctacaaaacgctctactcgaacacatacatatcaagagagaaactgttctcaaaagagtttgacatagagcacataatcccccaggcacgcctcttcgacgactctttctcaaacaaaaccctagaagcacgcagcgtgaacatcgaaaaagggaacaaaacagcatacgacttcgtaaaagagaaattcggggaatctggcgccgacaactccctagaacactacctgaataacattgaggacttgttcaaaagcgggaaaataagcaaaaccaagtacaacaaacttaaaatggccgaacaagacatacccgacggcttcatcgaacgcgatctgcggaacactcaatacatagccaagaaagcactcagcatgctcaacgagataagtcaccgcgtagtagcgacctccggcagcgtaacagacaagctccgcgaggactggcagctgatcgacgtcatgaaagaactgaattgggagaagtacaaagccttaggcctggtagagtacttcgaagaccgagacgggcgtcaaataggacgaatcaaggactggacaaagcgcaacgaccacagacaccacgcgatggacgccctgaccgtagcgttcaccaaggacgtcttcatacagtactttaacaataaaaacgctagcttggacccgaacgcgaacgagcacgcgataaagaacaaatacttccaaaatgggcgcgcaatcgcaccgatgccactccgagagttccgcgcggaagcaaagaaacaccttgagaataccctaatctcgatcaaggccaaaaacaaggtaataaccggtaacataaacaaaacccgcaagaaaggcggcgtaaacaaaaacatgcagcaaactcccagaggccaactccacctcgaaacgatatacggcagcggaaaacaatacttgacgaaggaagaaaaggtcaacgccagcttcgacatgcgaaagataggaacagtgagcaaaagcgcctaccgagacgcacttctgaagaggctttacgagaacgacaacgacccgaaaaaggcgttcgcaggaaagaactctctggacaagcagccaatatggctcgacaaagaacaaatgagaaaggtaccggaaaaagtcaaaatcgtcacattagaagcgatctacacaatccgaaaagagataagcccggacctaaaagtagataaggtcatagacgtcggcgtccgcaagatcctcatcgaccgcctcaacgaatatggcaacgacgccaagaaagcattctcaaacctagacaaaaacccgatctggctcaacaaagagaaaggaatatccatcaagagagtgacgatcagcggaataagcaacgcccaatccttacacgtgaaaaaggacaaagacgggaagccgattctcgacgaaaacggaagaaacatccccgtagacttcgttaacaccggaaacaatcatcacgtcgcggtatactaccgacctgtcatagacaaacggggacaactggtcgtagacgaagccgggaacccaaaatacgagctcgaagaagttgtagtctcgtttttcgaagctgtgacacgggcaaacctggggctacccataatcgacaaagactacaagacaacggaagggtggcagttcttgttcagcatgaaacagaacgagtacttcgtctttcccaacgagaagacaggattcaatccaaaagagatcgacctactcgacgtggaaaactacggcctcatctcccctaacctgttcagagtgcaaaaattctcactcaaaaactacgtattccgccaccatctagaaaccaccataaaagataccagctccatcctgaggggcatcacttggatcgacttcaggagcagcaagggcctagacaccatagtgaaggtacgggtaaaccacatcggacagattgtcagcgtcggcgagtactga

SEQ ID NO: 6845 - RNA, 4311 nt, synthetic construct
  misc_feature 1..4311: note = Cas9 variant
  source 1..4311: mol_type = other RNA
atgaaacggatcctcggactggatctaggcacaaattcgattggctgggcattagtcaacgaggcggaaaacaaggacgagcgaagcagtattgtaaagttaggcgtacgcgtcaaccccctcaccgtggacgaactgacaaactttgagaagggaaagtcaataacaaccaacgcagaccgtaccctaaagcgaggcatgcgccgcaacctccaaaggtacaaactcagacgcgagacactgacagaagtactgaaggagcacaaactaattaccgaagacaccatcctctcagagaacggaaaccgcaccacattcgaaacctaccgcctacgcgcgaaagcggtcacggaggaaatctcactcgaggagttcgcaagggtactcctcatgatcaacaaaaagcgaggttacaaatccagtaggaaagccaagggagttgaagaaggcaccctaatcgacgggatggacatcgcacgcgagctctacaacaacaacctcacgccaggagaactctgcctacagctgctggacgcaggtaagaaattcctccccgacttctaccggtctgacctccaaaatgagctcgacagaatctgggaaaaacaaaaggaatattacccggaaattctgaccgacgtgctgaaagaggaactccggggcaagaagagagatgcagtgtgggccatatgcgcaaaatacttcgtatggaaggagacctacacagagtggaacaaagaaaagggcaagactgagcagcaggaaagggaacacaaactagagggtatttacagcaagagaaagagagacgaggccaagcgtgaaaaccttcaatggagagtaaacggcttgaaggagaagctctcactagaacaactcgtgatcgtcttccaggaaatgaacacccaaatcaacaactcaagcgggtacctaggcgcaatctccgaccgaagcaaagaactgtatttcaacaaacaaacggtaggccagtatcagatggagatgctagacaaaaacccgaacgccagtctccgaaacatggtattctaccgccaagactacttagacgagttcaacatgctctgggaaaaacaagcagtctatcacaaggaacttaccgaagaactcaagaaagagatccgagacatcataatcttctaccagcgcagactcaaaagccagaaaggcctcattggattctgcgagttcgaatcacgccagatcgaagtagatatcgatgggaaaaagaagataaagacggtgggaaaccgagttatcagccgatcaagccccctctttcaagagttcaagatctggcagatattaaacaacatcgaagtcaccgtcgtcggcaaaaagcgaaagcgacggaaacttaaggaaaactactcagcaatcttcgaagaactaaacgacgcggagcaactcgagctgaacggctccagacgactgtgccaagaagaaaaagaactcctcgcccaagaactcttcgtcagagacaagatgaccaaatccgaagtactaaagctgttgttcgacaacccgcaggagcttgacctcaacttcaaaacaatcgacggcaacaagaccggctacgccctcttccaggcctactcgaagatgatagaaatgtccggccacgagcctgtcgacttcaagaaaccggtagaaaaagtagtcgaatatatcaaagcagtgttcgatctcctcaactggaatacagacatcctggggttcaattccaacgaggaactcgataatcagtcgtattacaaactgtggcatctattatacagcttcgaaggcgacaacacgccaacagggaacgggaggctgatacagaaaatgacagaactctacggattcgagaaagaatacgcaaccatactagcaaacgttagcttccaagacgactatggctcgctaagtgcaaaagccatccacaaaatcctaccccacctaaaagaggggaacagatacgacgtagcctgcgtctacgcgggctatcgacactcggaaagcagcctcacgcgagaagagatagccaacaaagtactaaaagaccgactaatgcttctcccgaaaaacagtttgcacaacccagtcgtagagaaaatactcaaccagatggtgaacgtcatcaacgtcatcatagacatctacgggaagcccgacgaaatacgcgtagagcttgcgagggaactcaaaaagaacgcgaaagagagggaggaactcaccaagtcgatagcccagacaaccaaagccaacgaagaatacaaaacccttctacaaaccgagttcgggctgaccaacgtgtcaagaacagacatacttcgctacaaactatacaaggaactagaaagctgcggctacaagaccctctactcgaacacatatatcagccgcgaaaagctattcagcaaggagttcgacatagaacacatcatcccacaagcacgactgttcgacgacagtttcagcaacaaaaccctcgaagccagaagcgtcaacatcgaaaagggtaacaaaaccgcctatgacttcgtcaaggaaaaattcggcgaatccggcgccgacaattcgctcgaacactatctcaataatatcgaagacctattcaagtcgggaaaaataagcaaaacaaagtataacaaactaaaaatggcggaacaagacatacccgatggcttcatagaaagagacctgcgcaacacccaatacatcgcaaagaaagcactgagtatgctgaacgagatctcacacagggtggtcgcaacctccggcagcgtaaccgacaaactacgcgaggactggcagcttatagacgtcatgaaagagctaaattgggaaaaatacaaagccctgggattagtcgagtacttcgaagaccgggatggccgccaaatcggacgaataaaagactggaccaagcggaacgaccatagacaccacgcgatggacgcccttaccgtagccttcactaaggacgtgttcatccagtacttcaacaataaaaatgcctccctagaccccaacgctaacgaacacgcgatcaaaaataaatacttccaaaacgggagggcaatagcccccatgcccctccgtgagttccgcgccgaagccaagaaacacttagagaacaccctgatctccataaaagccaagaataaagtcatcacgggcaatatcaacaaaacacgcaagaaaggaggggtcaacaagaacatgcaacagacgccacgaggccaactacatctggaaacaatctacggatccgggaaacaatacctgacaaaagaggaaaaagtcaatgcctcattcgacatgaggaaaatcgaaaccgtctccaaatcagcctacagagacgcccttctcaagcgactttatgagaacgacaacgaccccaaaaaggcattcgcgggcaaaaactccctcgacaaacaacccatctggctcgataaagaacaaatgaggaaagtcccggaaaaagtaaaaatagtcaccctcgaagccatatacacaatccggaaagagatatcaccggacctgaaagtagacaaagtaatagacgtgggggtcaggaagatactcattgaccgcctgaacgaatacggaaacgatgccaagaaagcattctcgaaccttgacaagaacccaatctggctcaacaaagaaaaaggcatttcgatcaagcgagtaaccatatccgggatctccaacgcccagtccctacatgtgaaaaaggacaaggacggaaagcctatcttagatgaaaacgggaggaacatacccgtggacttcgtaaacacagggaacaaccaccacgtcgccgtgtattaccgcccagtcatagacaaacgcggacaactcgtagtcgacgaagcaggcaacccaaagtacgaacttgaagaggtcgtcgtctcgttcttcgaagcagtgacaagagcaaacctcggactaccaataatcgataaagactacaaaactacagagggctggcagttcctcttcagcatgaaacagaacgagtatttcgtcttccccaacgagaagatcggcttcaacccaaaagagatcgacctgctagacgtcgaaaactacggcctaatatcccctaatctattccgagtacaaaaattctcactcaagaactacgtattccgccaccatcttgaaactacaataaaagacacttcctcaatactcagaggcatcacgtggatcgacttccgcagcagcaaaggactggacacaatcgtcaaggtcagggtcaaccacatcggacagatagtcagcgtaggagaatattga

SEQ ID NO: 6846 - RNA, 4311 nt, synthetic construct
  misc_feature 1..4311: note = Cas9 variant
  source 1..4311: mol_type = other RNA
atgaaaagaatcctcgggctggacctaggcacaaacagcatcggatgggcactggtagatgaagccgaaaacaaagacgaacgaagttcgatcgtcaagctcggagtgagggtgaacccactgaccgtcgacgaactcaccaacttcgaaaagggaaagagcatcacaacaaacgcggatagaaccctcaaacgaggaatgcgccgaaacctacaacgctacaaactcagaagagagaccttaatggaagttctcaaagagcacaagctaatcacagaagatacaatcctaagcgaaaacgggaaccgaacaacgttcgagacctaccgactacgagcaaaagcagcaaccgagaaaatctcgctggaagagttcgcacgggtccttctcatgataaacaaaaagaggggttataaatcctgccgtaaagccaaaggcgccgaagaaggtaccctaatagacgggatggatatagcacgcgaactatataacaacaacctgacccccggagagttatgcctgcaactactggacgccggaaagaaatacctacccgacttctaccgaagcgacctccaaaacgagctcgaccgcatttgggaaaagcagaaagaatactaccccgagatcctcaccgaagtactaaaagaggagctgcggggaaagaaacgggacgcagtgtgggccatatgcgccaaatccttcgtttgggaagaatactatacagaatggaacaaggaaaaaggcaaaacagaacaacaagaacgcgagcataaattggaagggatctacagcaaaagaaaacgcgatgaagcgaaaagggagaatctccaatggagagtaaacggattaaaagaaaaactatcactcgaacaactggtgatcgtactacaagaaatgaatatccagatcaataatagcagcggttacctaggcgcgatctccgaccgctccaaggagctctacttcaataaacaaaccgtcgggcagtaccaaatggagatgctagacaaaaaccccaacgcatcccttcgcaacatggtcttctaccgccaagactatctagacgaatttaataccctatgggagaagcaggcagagtaccacaaggagctcacgggggagctcaagaaagaaatacgcgacatagtcatcttctaccaaaggcggttaaaatcgcaaaaaggtctggtcggcttctgcgagttcgaaagccgacaaatagaagtagagatcgacggcaaaaagaaaataaaaaccgtcggaaatcgcgtaatacccagaagctcaccactcttccaagaatttaaaatatggcagatccttaacaacatagaagtgacagtagtcgggaagaaaggcaagcgaaggaaacagaaagacaactcgccaaccctattcgacggactcgacgacacagaacaactcgaactaaacggaagccggtatctataccaagaagagaaggaattactagcccaggaactattcgtgcgcgacaaaatgaccaaatctgacgttctcaaactactcttcgacaatccccaagagctcgacctgaatttcaaaactatcgatgggaacaaaacgggatacacgctattccaggcgtacagtaagatgatcgagatgagcggacacgaacccgtcgacttcaagaaaacggtcgagaaagtcgtagaacacgtcaaggcagtcttcgacctcctgaactggaacacagatatacttgggttcaactccaacgaggaacttgacaaccaaagctactacaaactatggcacctactctacagcttcgagggagacaatactcccaccggcaatgcacggctggtccagaaaatcacagaactgtacgggttcgaaaaagagtacgccattatcctcgcaaacgtgaccttccaagacgactacggctcgctctccgctaaggccattcacaaaatactcccacacctgaaggaaggcaaccgatacgacgtagcgtgtgcgtacgcaggatacaaacacagcgagagctcgctcacgaaagaagagatagcgaacaaagccctcaaagatcgactgaccctacttcccaaaaacaacctgaggaatcccgtcgtagagaagatcctaaaccagatggtaaacgtcataaacgccatcatagatacatacgggaagcccgacgagatccgcgtggaattagcccgcgaactgaaaaagaacgccaaagaaagggaagaactcaccaaattcatcgccgaaacaacccgcaaacacgaagagttcaaaatcctgcttcaatcagagttcggcctaacgaacgtgtcacgcacagacatactccgatacaaactctataaagaactggaaagctgcggctacaagactctatactccaacacgtacatcccgagagaaaaactcttcagcaaagagttcgacatcgaacacataatcccccaagcacgactgttcgacgactcattctcaaacaagacactagaagctcggtcgatcaacctagaaaaaggcaacaaaacggcctacgatttcgtaaaggaaaaattcggagaaagcggagcagacaacagcctcgaccactacttgaacaatatagaagacctcttcaaatcgggaaaaatctctaagacgaaatacaacaaactaaagatggccgagcaagatatcccggatggcttcataaatcgagacctgcggaacacccaatacatcgcaaagaaagcgcttagcatgctaaacgaaataagccgccgagtagtggccacatccggcacaatcaccgacaaactccgacaagactggcaattagtggacgtaatgaaggaactcaattgggagaaatacaaagcgttaggactcgtagagtactttgaagacaaagacgggcggcaaatcggtagaatcaaggactggaccaagcgaaacgaccaccgccaccacgccatggatgcgctgaccgtagcgttcacaaaagacatcttcatacaatactttaacaacaaaaacgcaagcctcaactccaacacgaacgaatacgcaataaagaacaaatacttccagaacgggagggcgatcgccccgatcccactgagagagttccgcgtagaagcgaagaaacacctcgagaacacgctgataagcatcaaagccaaaaacaaagtggtgacgggcaacataaacaagaccaaaaagcggggcggagtaaataagtatctccaacaaactccacgggggcagctacacctggaaacaatatacggcagcggaaaacaatacctgaccaaggaagaaaaggtcaacgcgagctttgacatgaaaaagatagcaacagtaagtaaaagtgcataccgagacgtcctattaaagcggttacacgagaatgacaacgaccccaagaaagccttcacgggcaaaaactccttggacaaacagccgatctggctcgacaaagaacagacccgcaaggtcccagaaaaggtaaaaacagtcacactggaaacaatctacacagtccgtaaagaaatcagcccggatcttaaagtagacaaggtgatagacgcaggagtaaggaagatcctaaccggacggctaaacgaatacggaaatgatgccaagaaagccttctcaaacttagacgagaacccaatctggctcaacaaagagaaaggcatatcaataaaacgcgtaactatctccggtatctcgaacgctcagagtctgcacgtgaagaaagacaaagacggaaagcccattctagacgaggacagccgaaacatcccggtagactttgtaaacacggggaacaaccaccacgtcgcagtatacagaaggcctgtaatcgacaaacgaggccagctggtgatcgacgaagcaggcaatccgaagtacgagctcgaagaggtcgtagtcagcttcttcgaggcggttaccagagcaaatctcgggcaacccatcatagacaaggactacaagacatccgaagggtggcaattcctattcagcatgaagcagaacgagtacttcgtattcccgaacgagaaaaccggcttcaacccaaaagaaatagatctcttagacgccgagaactacggcgtcatatcacccaacctattcagggtccaaaaattcgcgcacaaaaactacgtcttccgccaccacctcgagactacaataaaagacaccagctcaatcctcaagggaataacctggatagacttccgctcaagcaaaggtctcgacgcaatagtcaaggtacgagtaaaccacatcggacaaatcgtaagcgtcggtgaatactga

SEQ ID NO: 6847 - RNA, 4311 nt, synthetic construct
  misc_feature 1..4311: note = Cas9 variant
  source 1..4311: mol_type = other RNA
atgaaatacattaaatacatactcggacttgacatcggaagcaactcgatcgggtgggcattgatacagctcgacctcctacagaagacgaagaggataattgctgcaggcagcagaataatccccatggaccaaaaagtactgagcgacttcggaaagggaataacaatcagtcccacggcccagagaacgagctaccgcaatgcccgacactgcagagaacgtcacctcctccgcagagaaagactccatcgtgtgctacacatactcggattcctccctacacactacgacaaacagatcgacttctccaaaagatacggcaagttcgtcgacaacacggagccaaaaatcgcgtacaacgagggcaaattcctattcatggacagcttccaagagatgctcagcgacttcaagagccaccaacccgacctcttttacaccaaaaagaacggcgaagagtcgaaaatcccatacgactggacgatttactacctccgcaagaaagccctcagccagaaaatctccaaagaggagctagcatggataatcctaaacttcaaccaaaaacgtgggtactaccagctccgcgaagaagaggggaacaaagagaacgactttgaaatcataagcagcaagatcataagcgtaatcaagaaagacaaagacaagaaatataacaaatactggtacgacataatcctcgaaaacgggctcgtctaccaggctgccttctataacgatttcgtttacaactggattaatcaagaccgggagttcatcatcgaaaggacctctctcaaaaacggcgccgaaaaagtcaaactaagctacctacccacattcgacgaaatcgacaagatggacaagaaggagcaagacaaatactacaaaaagattaaaatcaagaccgaaaactcgatcggcaacaagactgtaggctgctacatctacgaccatatcctacaaaaccctaacgagaaaatcaaaggcaagctcgtgaggaccatcgaacgcaaatactataaagaagaattaaaagccatcttggagaaacagatcgcactgcaaccagaacttttcaccgaccaattactcgcggattgcatccgcgaactctacagcaagaacgaagcccaacaacgcaacctggccgcccgagacttcgttcacctcctcgtcgaagacataatcttttatcaaagaccactgaggcgccaaaagagcacactcgccaactgcagcctcgagtcgcgatcgtacatcgacaaagactcgcacacccggaaggaagcccccttgaaggtatgcccaaagagcaacccctattaccaggagttccgtgtgctacagtggttacaaaacctaaagatatacgaaatcgacagcgaccaggaagtgacccaccagttcattaagacgctagaagacaaacagcaactcttcgaatttctcatggctcagaaagaaatcgattgcgaggaactactcaaatacttccttaatcaaacctacccaaacgcaaaagaaaaggcactcaaaagcgagctaaagaaatggaaagacacatacagatggaactatgtttacgacattggcgagaaaagtagtaagaaatatccgatgaacgaaacgcgttacgagttaaaacgccacctggaaaaagttgcgaatctcccagatgatttcctatcatctgaagtagaatacctactatggcacctcatatacagtgtgaaagacaaagtggcctacgaaaagggcctcaagaaattcgcccagaaacaccacctagacaaagactcattcgtggagagcttcaaaaagttcaatccctatcccagtgaatacgggagcttttccgaaaaagcgatacgaaaactgctaccactcatgagattcggagcgcactgggacttcaaccacatcgacaagaacactcagaaacggatcgaagacctcatcacaggcgtagaaaacgaagaaatccgtaccatcctcagggagaaagccgaaaaatatcagctcgagaaggagaccgacttccaggatctccccctctggctcgcccaatacatagtctacaaccggcacgcagaggctagctccttagagaaatggacctcagtcaacgacctagaaacctatctgaacgagttcaaacagcacagcctaaggaaccccatcgtggaacaggtcgtaatggaaaccctccgcgtagtccgggacatctggcaacagtacggccaaggccaggcgagctttttcaacgagatacacatcgaactaggccgagagctaaagaagacagccaaagaacgggaaaaactctcgaaacagaaccagaaaaacgaagacataaacctatccataaaagaaaaactaaaggagctagaaaagtataacacccgggcctatagcattacacaccaggagaaatacaaactgtggctagaacagaaacacatctccccgtacaccggacagatcatctcccccgagaacctctttacagacaactatgagatcgaacacataatcccgcaatcccgtttctttgacgactccctcagcaacaaagtagtctgcgagagcatcgtcaacaaggccccttacaaagaccgacaactcggacttgagttcatcaagaatcagggcggtagaatagtaaaagaactatccaaagagaacaaaacaataaaaatctttaccgaggaacaatatcgcactttcataaaagagcactacagcaacaacccagaaaagacaaagaaacttctcctcgaagaaattccggagaagatggtcgcacggcaaatgaatgacacgtgctacataagcaaattcatctccgaaatcctaagcaaaattgtacgcagcgacgaacaagacgaaggagtccactccaagaacgtcatcctatgcaccgggaaaataacctccatactacgccaggactggggtctaaacgacatatgggacaacctcatactcccccgtttcgagcgcatgaacaacctgctgcaaaaagaaaaatttacaatatacagtattgagaaacagaagaaaatccccgtcgtccccatcaatgaccaattcaaatccttccagaagaaaagaatagatcaccgccaccacgcgatggacgcaatcatcatagcctgcaccaccagagagcacatcaactacataaacaaccaacacgccctggaaaaggaaaaggacaaaaaggaaaaacaagaggagcgggacaaacttcgcgagaaactgtgcatcaagaaatacaataaccgatccgaggggaactactcatggatattcaagaaaccgtgggacacctttacccaggaggtacgagtcgcactagaggacatcgtcgtctcatttaaacagaatctacgcgtcataaacaaagccacgaactattacgaaagatgggtagaagagaacggcaaatacatcaaaaagatggtcaaacaggaaggaaccaactgggcaatacgcaagcccctacacgaagaaaccatttccgggaagatatacctcgaccgggagaagataaccaaaaacgacatcctaacagccacccgtaaaaccgttgactcgagcttcgatgacaaaagaatcaagaaaatcaccgacacaggcatccagaaaatccttttgaactacctcaaatacaaaggctcccccgaaatcgcattctcccccgagggcctcgaggaactcaacaaaaacctctccatatacaacgacggcaaaccccacaaaccaatctacaaagttcgcatatacgagaagggatcgggccggttcgccctgggagaaaaaggaagaaagtacaagaaatacgtccagggggccagcaacttgtatttcggcatctaccagggagccaaacgctcgttcgccacaatccccctaaacgaggtcattgagcgacagaaacaaggtctcccatcggtccctgagtacaacgaaaagggagacctactcctattcagcctgagtccaaatgacctcgtatacgtgcctatcgaaggagaaatcatcgaaaacatagactttcgcaacctctcgaaggagcaaaaggagcggatctacaacgtgaacgatttctcctctacctgctacttcacacccaaccgaatagcaaaggccatattcccaaaggaggtagacctccaacgcaagggcgacaagctcagcggcagctacgacacaaaaactgcgagcttggaagggatccagataaaagaagtctgcatcaagctcaaagtcgaccgactcggcaacatcagcaaagcatga

SEQ ID NO: 6848 - RNA, 4314 nt, synthetic construct
  misc_feature 1..4314: note = Cas9 variant
  source 1..4314: mol_type = other RNA
atgaaatacataaaatatattctcggcctagacatcggcagcaactccatcggatgggcgctcatccaacttgacctgctacagaaaacgaaaagaataatagccacgggctcccgaatcataccaatggaccaaaaggtcctatccgacttcggcaaggggattaccatctcccccaccgctcaacgaacctcataccggaacgctcgccactgcagagaaaggcaccttctaaggcgcgaacgacttcatagagtccttcacatacttggcttcctcccaacacactacgacaaacaaatcgacttctccaagcgctacggaaaattcgtcgacaacaccgaaccgaaaatagcctacaacgaacgaaagttcctatttatggacagcttccaagaaatgcttgctgacttcaagatccaccagccggacttgttctacaccaagaaaaacggagaggaaagcaagatcccatacgattggaccatatactacctaagaaaaaaggcgttgagccgcaagatcagcaaggaggaactggcctggataatcctaaatttcaaccagaaacgtggctactaccagttacgagaagaagaggaggaaaacaaggaaaatgacttcgaaatcatatccagcaaaataatcagcgtgatcaagaaggacaaagacaaaaaatacaacaagtactggtacgatatcatcctcgagaatggcttggtataccaggccgcattctacaacgactttgtatacaactggatcaaccaagaccgagaattcataatagagcgcatctccttaaaaaacggaacagagaaggtgaaactgagctacctccccacgttcgacgaaatagacaaaatggacaaaaaagagcaggacaagtactacaagaaaatcaagatcaaaacggaaaacagcatcggcaacaagaccgtcggatgctacatatacgaccacatcttacaaaacccaaacgaaaagatcaaagggaagcttgttcgcaccatagaaagaaagtactacaaagaagagctaaaggcaatcctggaaaagcaagtagcgctgcaacccgagctattcaccgaccaactcttcgccgactgcatacgggaactatacagtaaaaacgaagcacaacaacgcaacctggccgcacgtgactttgtccacctgttcgtagaagatataatcttctatcaacgatctttgcgccgacaaaaaagcaccctggcgaactgttcgctagaatcgcgaagctacatcgacaaagacagccatacgcgtaaagaagcacctctaaaggtgtgtcccaagtcaaacccatactaccaggaattccgtgtgctccagtggttacagaacctgaaaatatacgagatcgacaccgaccaagaggtgacccacgaattcatcaaaacgctagaagacaaacagcaattcttcgacttcctcatgaaccaaaaggagatcgactgcgaagaattacttaagtacttcctaaaccagacatatcccaacgcccgagaaaaagccctgaagagcgaattaaaaaaatggaaggatacctaccgatggaattacgtctatgacatcggcgaaaaaagctccaagaagtaccccatgaatgaaacacgatacgagctaaagcggcacctagaaaaagtcgccaacctgcccgacgacttcctatccagtgaggtagaatacctcctatggcacctaatctactcggtaaaggacaaagttgcctacgaaaaaggcctcaagactttcgcgcaaaaacaccacctcgacaaggactcgttcgtggaaagcttcaaaaagttcaaaccatacccctctgagtacggatccttttccgagaaggctatacgcaagctcctgcccctaatgcgattcggcagctactgggacttcaaccacatagacaaaaacacccagaaacgaatcgaagacctcatcacgggagttgaaaacgaagaaatacgcacaatactcagagaaaaggcagaaaaataccaactagaaaaagaaacagacttccaagacttacccctctggctcgcgcaatacatagtctacaataggcacgccgaagcctcaagcctcgagaagtggaccagcgtgaacgacctggagacgtacctcaacgaattcaagcaatacagcctcagaaaccccatcgtagaacaggtcgtgatggagaccctccgggtagtgcgcgacatctggcagcagtacggccaaggccaagcctcgttcttcgacgagatccacatagaactaggacgagagctcaaaaagacagcgaaggaacgtgagaaactatcaaaacaaaaccaaaaaaatgaagacatcaatctctccatcaaagaaaagctaaaggagctagagaaatacaacaccagagcatactcgatcacacaccaagaaaaatacaaactctggctagagcagaagcacatcagcccatataccgggcagatcatatcccccgaaaacctgttcacggacaactacgagatcgaacacatcataccccaatcacgattcttcgacgacagcctctcgaataaagtcgtctgcgaaagcattgtaaacaaagcgccatacaaagaccgacagctagggctagaattcatcaaaaaccaaggaggcagaatcgtaaaagaactcagcacagagaacaagacgatcaaaatattcaccgaggagcaataccgaacgtttataaaggagcactattccaacaaccccgaaaaaacaaagaagttgctattagaagagattcccgaaaaaatggtcgcccgccagatgaacgacacctgttacatcagcaagtttatcagcgaaatactatccaagatcgtccgcagcgacgaacaagacgaaggagtccactccaaaaacgtaatcctatgcacaggcaagatcacgagcgcgcttaaacaagattggggggtcaacgacgtatggaatgacctcatactccctcgcttcgaacgtatgaacgatctcacccagtcaaccctgttcactacgtacaacgaaaaataccaaaagtacctgccaaccgtccccatggaatatagcaatgggtttcaaaaaaagcgaatagaccacaggcaccacgccatggacgccataatcatagcctgcgccaccagagaacacattaactacatcaacaaccagcacgcactagaaaaaggaaaggacaagaaagaaaaacagaaggagcacgacaagcttcgcgaaaagctgtgcattaaaaaagacaataaaggtagcgaagaaaactacagttggatattcaagaaaccctgggacaccttcacccaagaggtacaggccgccctagaaggcattgtcgtatccttcaaacagaacctaagggtcatcaacaaggccaccaattactatgaaagatgggtcgaagaaaatggcaaatacattaagaagatggtgaagcaagagggcaccaactgggccatccgaaaaccgctccacgaagaaaccataagcggaaagatctacctcgaccgcgaagagatcaccaaaaacgatatcctcaccgccacgcgcaaaaccgttgacagctcattcgatgaaaaacgtatcaaaaagatcaccgatacggggatccaaaaaattctcctcaactacctaaaatacaagggctcgcccgagatagcattcagcccagaagggctcgaagagctgaacaaaaacctcagcatctacaatgacggaaaaccacacaagccaatctacaaggtcagaatatatgagaaaggttcaggccgattcgcactcggcgagaagggtcgtaaatacaaaaaatacgtacaaggcgcaccgaacctatactttggcatctaccaaggagccaacaaacgatcgttcgcaacaataccacttaacgaagttatagaacgccaaaaacaaggccgaccatccatccccgaatacaacgaaaagggagaccccctcctcttctcgctcagccccaacgacctcgtctacgtgccggtagagggagaaatcatcgaagatattgacttccaaaacctctcaaaagaacaaaaagagagaatatacaacgtaaacgacttctcctccacgtgctacttcaccccaaaccggatcgcgaaagccatattccccaaagaagtcgacttgcaacggaaaggcgacaaactacccggtagctatgacacaaagaccgcatcccttgaaggcatacagataaaagaggtctgcatcaagctcaaaatcgatcgactagggaacatcagcaaggcctga

SEQ ID NO: 6849 - RNA, 4317 nt, synthetic construct
  misc_feature 1..4317: note = Cas9 variant
  source 1..4317: mol_type = other RNA
atgaaaaccatcctcgggctggacctcggaacaaacagcatagggtgggccctcatcaaacaaaattttgagaacaagtacggcgaaatcctaggaatgggaagccgaataatccctatgtcccaagacatactaggcgaattcggaaaaggaaacagtgtcagccaaacagcagcacgcacagactatcgagccacgcgaaggctacgtgaacgattcctacttcggagagaaagacttcaccgagtcctcaatgttctcaacttccttcccgaacactacgcaagccaaatagactttgacaaaagattcggaaaattcaaagtcgaaacggagcccaagctcgcgtggaaaaatattgacggaaagttcagtttcctctttcaaaccagcttcaacgagatgctcgaagactttaaggcgcacggacaggacctaaaagttccctatgactggactatatactacctccgcaaaaaggccttaagccaaaaaatcgagaaagaagaactggtctggatcctactcaacttcaaccaaaaacgcggctactatcaactcagaggcgaagaagaggaggagaaccctaataaattaatcgagttctactcactgaaaatcatcgatgtcctggcagacgagccgcagaaaggcaaatccgacatatggtatagcctcgtactcgagaacggatggatctaccgaagatccagtaagacatccctacttgactggaaagataagattcgagacttcatcgtcacaacagacctaaatgacgacggctcagtcaagacggacaaagagggcaacgaaaaacgctcattccgcgccccaggagagaacgattggacgcttgtgaaaacaaagacggagcaagagatagaccgctcacggaaaactgttggcaactacatctacgagacgctgctacaaaaccctaaacaaaaaataaaaggcaaactagtacgaacaatcgaaaggaaattttacaaagaagaacttaaaaggatcctagaaaagcaaaaagaattccaccgggaactggagtcgaacgacctgtacaacgactgcatcagagagctctatcgcaacaacgaggcacaccagctcacgctatccaaaaaggacttcgtgcatctctttatggaagacataatcttctaccaacgcccattaaaatcccaaaaatcctccatcagcaactgcacgctggaattcagaaaatacaaggacgaaaacgggatagaacacacccagttcctgaaggcaatccccaaatcaaacccatactaccaagagttccggatctggcaatggatctttaacctcaacatatacaaaaaagacaacgacgacaacgtcacgaaagaattcctaaatacaacgcgcgatttcgaaaacctattcgaattcctgaacaacaggaaagaaatagaacaaaaaccgctcctcaagttcctgctcgagcaaaaggagttcaaaggaaaactgctcaacgccgaaaccgagaaattcagatggaattacgtcgaggacaaaaaatacccgtgtaacgaaactcgcacaatgatatccgaacgactgaaaaaagtggaaaacatatcggacgacttcctcacccgagagatggaacaaaaaatttggcacatcatatactccgtcaacgacaaaaccgaatacgaaaaggcgctcaagagcttcgcggaaaagaacaacctagacgagaactcattgttcgaggcattcaaaaaattaccacctttcaaatcagaatatggcagctttagcgagaaagcaatcaaaaaactactgccgcttatgaggctaggtaaatactggtcatacgccaaaatagacctctacagcaagaaccgcatacaaaaaatcatcaccggggagttcgacgagaatatcaaggaccgggtccgggagaaagccattagactcaccgctgagaacgattttcaaggcctccagctgtggctggcacaatacatcgtgtacggccgtcacagcgaggcctcaatgatcggaaaatggaattcggccgacgacctcgaagagttcctcaaggaattcaagcaacactccctccgcaaccccatcgtagaacaggtaatcaccgagaccctcagaattgtcaaggacatatggctgaaatacgggaacggcgcaaaagacttcttcaacgaaatccacatcgagctcggacgagagatgaaacagacgaaagacgagcgagcaaacgcaaccaaaacaatcacggaaaatgagaacaccaatcttagaatcaaagcgctactcgcagaaatgatgaacgaccacagcgtggagaatgtccggccctactcccccatgcaacaggaaatactcaaaatatatgaagacggaatcctgaaatccgacatcgaaatagacgacgatatactaaaaatctctaagacggcacaaccctcaagcagcgatttaaaacggtacaaactctggctagagcagaagtacaaatccccgtacaccgggcaaatcatccctctgaacaaactctttactccggaatacgaaatagaacacatcataccgcaatcccgatatttcgacgactccttctcgaacaaaataatctgcgaatccgctgtaaacaaactgaaggacaactacataggcctaggcttcataaagcagttcgggggaaccatcatagaatgcgggttcggtaaaagagtaaaagtgttcgaggtcggcgagtacgaggaattcgtcaaaaagcactacgcgaacaaccgagggaagcgcaacaaactactgctagaagagatcccagagaaaatgatagaacgccaaatgaacgacacccgacatatctccaaatacattagcggaatcctctcccacatcgttcgagtcgaggatggaacagacgagggcgtgaacagcaagaacgtaataccaggcaacggcaagattaccacccaactacgccaagattggggcctcaacgacgtatggaacgaacttatccttccacgattcgaacgcatgaatcaactaacgaactccactgatttcacgtcctggaacgagaaccaccaaaaatacctccccaccgtcccggtcgagttctccaaaggcttcagcaaaaaacgcatcgaccaccggcaccatgcactagacgcactggttatagcatgtgcgacaaaagaccacgtaaacctgctcaacaaccagagcgcgaaatccgcaaccaaacgttacgatctgaagaaaaagcttatgaaattcgagaagacagtatataaggacccccaaaccgaaaagcgtatcgaaagagaggtcccgaaacacttccttaaaccctgggaaacttttaccgtagacgccaagaatcgcctcgaaaccataattgtatccttcaaacaaaacctacgagtaatcaacaaagccacaaactactacgagaaatacgtagaaaaagacggcgtaatgatgaaagaacgggtcgagcaaacaggcacaaactgggccatccgcaaacccatgcacaaggagacggtctctggcaagattgacttaccatgggtaaaagtcccgaaaggcaaaatacttacagccaccaggaagagcctagacacctcattcgacctaaaggcaattgcaagcatcacagacacgggcatacaaaaaatcctgaaaaactacctggagttcaaggagtccccagaactcgcgttctctccagaaggcatcgaagacatgaacaaaaacatcgaaaagtataacggcggccgaccacaccagccgatctctaaggtacgagtctttgagcttggatcaaaattccaagtggggcaaacaggaaacaaaaaagacaaatatgtcgaggccgccaagggcacaaacctcttcttcgcaatctacgaagacaagaagggtaaacgctcctacgaaactataccgctaaatgaggtcatcgagcgccaaaaacagggactctccgtggtcgacctgaagaacgtaaacgacttctttctttgccccaacgacctcgtctacataccgtcgggcgacgaattcgaaaaccgtggcagcatcgaaatcgagaacatcacaaaagagaaaagcgaaagattctacaaggttgtctcattcagcgggagccagatcttcttcgtacgccacgacattgcggtgtctatcgttaacaaaggcgaattttcaaccctcaacaaaatggaacgcgctatagacggctccatggtcaaggaaatatgcatcaagttgaaaatcgacaggcttggagacgtcctgaaagcctga

SEQ ID NO: 6850 - RNA, 4317 nt, synthetic construct
  misc_feature 1..4317: note = Cas9 variant
  source 1..4317: mol_type = other RNA
atggtcaaaaagggatacacaataggcctcgacatcggcacaacctccgtcggctgggctgtcacggatgacgacttcgagctagtcaacaagaaaatgtctatcaaagacaaaagcggctctacgatcaagagggtgcggaaaaacctatggggagtccgcctcttcgatgaggcgaagacagcggagaacacccggcggacccgcggcgtgagacgtcgaatccggcgccgtaaggagcgcctcaactatctccaaggcatcttctcctcggagatggcaaaaatggacgagaatttcttcatgcgccttgaagagagcttcttcaaactctcagacaagagcgaacagaacaaattcccctatgcgctattcaaaaacgagatagaggagaaagcatattaccgacaatttccaaccatttatcatcttagaaaacatctcatggaacatgaggaatcagacctaaggaagatctatctaggcctgcaccatatactgaagtaccgcggccactttgtgcaggaaggccaaaagatggacgtagccaacattgatatacagggtaatctaaaagaactcttcaacgccctcaacgagaactttagcaacaaagaggatgacttcgagcaagagcggatgaaggacggcgtaaagcgcgccaaagttctctttgacaccgagaaactagccgcagtcgaggagatcctaaaagaaaagataagcaaaagctggaaagtgaacaagatatcaaaaggcatcctggccgaaaagaaagacctcccaatcttcaaagccatcgtcgggaacaaaatagacctcgccgggatcttcgactgtcccgactacgcggaaaaagtaaacgaatcaatcaaagaactcaaggataaagtctacttcaacaaagaggacttcgaagaaacatttgagaaactgtctcagctacttaaggaagaggaacttgagatcctaatcctcgcccggaagtgttatgaagccgtgctgctggccgacatcatgcaaggcgaacaatcactaagcgacgccatggtcgccaaatacaatgaccacaagaaggacctagtcatcttcaagaaattcgtcatagactacttcagcgaagacgtctacttcgacctgttcaaaaatacacaactggccgggaactatcacagttacgtaaaaggcgaaaggaaggggaacaaatttaaccacgccagcctcgacgacttctacaaatttgtgaaaaaggaactggacaagaaagcagaggaactgtcagagcaccccgtatacaaacaaatactccagaaaattgaactcgagaccttccttccgaaacaacggatgttcaagaacggcgcaataccctaccaggtacatctccacgagctccgggcaatcatcaaaaagcaagaaaaacgtttcccctttctcgcagagaaaataattataaaggacaatcagaaggacataagcgaatacaaaatcgaaaccctaatgaaattccgcataccctactacgtcggacccctcatcgaagcaagggaaggcgaactcggcaaaaagcggacaaattacagccgattcgcatggatgcaaaagagccccgaaagccaaaacatcggcatcacgccatggaacttccactctgtcgtcgacaaggacgcatcggcctctgagttcatcgaacgcatgaccgggttctgcagctactttccggaagaaccagttctgccaaagaacagtctaatataccaacaattcacggtatttcaagaactcagcatcgtcggctactacgacgaacagaaccgaaaacactatctggacggggagaccaggcgacgcatattcgaggacctcttcaagaaaaaccgaacagtgagcgccggcctactgcgcaaatggctggtatgcaaccagcggaccagtcaagaggaaaaagagattagactcttcggcctggatctcaagaaaaacggcctcggcagcgggaacttcaatacaaaatatactacctacctagacctcaaagacgcagggatcaccgaaaagcaactcaaacagcataaagacttcttcgagaaaatcgtaaaataccaaaccatcttcgaagacaaaaagattttaaagcgccgcatcatcctattaaacgaagaacagcccctcctatccgaagaacaaatcaagaacctcgcgaagaaacactatactggatggggcaacctgtcgctcaaactgatagacggcattcaagacaaaggaaaaacaatactggattacctcgagacacaagactacaatcagaacctcatgcagctcatgaacgacgaaaacaagagctttgaaatgcaaatcgagcaagccagggccggaaaagtccaattcggcaaaatcgactattccttcgtcgaacaactagccggcagccccgccatcaagcgcggcatctggcaaagccttcaaatcgtggaggaactcgttgcgttcctggggaaggaaaatatcaagaaaatagtgatcgagatggcgagggaaaaccagagcagcaaacggaccaagtcccgccagaaacagatcgaagccctctaccaaaaagtaacaggcgaccttaaaaatgagcaggagaaaatcgacgtaatgcaaaacttcgataacgaacgagtgttcctatactacctgcaaaacgggaagtgcatgcacagcggcgaaaaactcgaactcagccaactgtcagaatacgaaatcgaccacatcattccacaaacatacataaaagacgacagctttgacaacaaagttctcgtaaccagaaacgcaaatcaacaaaaaggcggggacgttccctcctacgacgtaatcgacaaaatgaaatcctactgggaaaagctcaaggagaacaacctcatctccgaaaagaaattcgcaaacctgaccaaaggaaaattcgacgatcaacagctgtcgggcttcatcaaccgacagcttgtagagacccgacagataactaagaacgtagcaataattctagacaaaatatataacgacgaagccaaaaacgaaaaggaggtagcaataatcacccttaaatccgccctgacatcgcagtaccggcagggcatcatatacgtccccaacgacgacttcgacgaacttaagctagtcagtaaaaccaactcgcggctgaaagaagtaaaactgcacgacggcttctacaaagtacgagagatcaacgactaccaccacgcgcacgacgcctacctaaacaacgtcgtggccacgtacctatacgaagccatgcccgacctaagacccttgttcgtatacggggagcacagcagggaaatccataaaagatttctaggcaagtacgcgacaacacgcaagggccaatttaagcaactgctcgtagacatgcaggacgagtactggatgcgcaaggacaaagaaggtaacttcatcgatggcgagatcctatggagacgggacgaagtgctccaaatcgtaaagaaagtactcgactaccgaaacatacaaatcaccaagaaacttgaaatgatggtgaccggcggagaagaaaaatcattctaccaagacagtcgctgccgtaaggataaaacagccataccatataaaaccaattgggatccgagcaaatacggcggcttcaaatctccccgaacagcctacgcaatcccggtcatcaagaaaaacaaacccaaactggaaccagtactactcgtcaacagaagcaaagtagagaccgacggacaatttgactgcgaaaagttcaaggagcttaacccgaccttaaaaatcctcgggcagccaatctggaaataccagtcattcgagatgttcgatggaaccaaacgctacatcgcctccgcctcggaaatccacaaagggaaccagatcaagttttcccaagaacacatgaaattcatcagctgctgccaaaagtacgacgaagtcaaaaacaagctagccttcgactttgtcaacgaatccaaacacctgttccaagaaatccttacagccatcaaggataacatccaccgttatcgcctcatcgccgaaggcattgaagttcaccgcaagttctccaacatgctggagaacatcgaaaagctaagcacccaggaactcgttgataatttgctggacgccatcaacatcaccagcgtcggcaccacaaacaacgcctttggccgcgtccgttataaaggcagttacctcaacgaaatctggtcggccaccctaattcaccaatcggtaaccggcttatacgagacacgcgaaaaactaatctga

SEQ ID NO: 6851 - RNA, 4323 nt, synthetic construct
  misc_feature 1..4323: note = Cas9 variant
  source 1..4323: mol_type = other RNA
atgaaaaccatactaggtctagacctaggcacaaactccataggatgggccctagttgagcaagacttcgaaaataaacaaggtctaatcctgggaatgggcagccgtatcataccgatggacgcgggcattatcggaaaattcgccgaaggctccagcataagccaaaccgcagagcgtacaggctaccgcagcatccgacgtctacgagagcgacacttgctcaggcgggaaaggctgcaccgggtcctcaacatactaaaattcctgccagaacactacgcagccgaaatcgacttcgaaaaacgcttcggccaattcctggcagaaaccgaaccaaagctcgcatggaagaaatcggcggaaggaaaattcgagttcctcttccaacgatcatttgacgagatggtcgccgacttcaaagccaacgggcaagacattaaaattccatacgactggacaatctattacctccgcaagaaagccttaacccaaaagatctcaccgcaagaactcgcatggatcatactcaatttcaaccaaaaacgaggttactaccaactcagaggagaggaggaggaagagaacccgaacaaaaaggtcgagttctactcgctaaagatcgtagacgtagttgccgacgaacaaccaaacaagaagggggacacctggtacagcctacacctcgaaaatggttgggtctatcgcaggtcgtcgaaaatccccctctacgattggaaggacaaagtgcgagacttcatcgtcacaacggacataaatgaagacggctcggaaaagctagacaaagacggggaggtcaaacggtcatttcgagccccaaaggaggacgactggacactcatcaaaaagaaaacagagcaagagatcgaacaatttaaccaaaccgtcggcagttacatatacgaggccctcctcgacaacccgacgcagaaaataagaggaaaactggtccggactatcgagcggaaattctacaaatccgaactaaagaaaatactagaaaaacaaatagaactacagccagagctgttcaccgaggacctctacaacgcatgcgcccgggaactataccgttcaaacgtagctcaccagcaacagctctcgtcaagggacttcgtctacctgttcctaaacgacataatcttttatcaacgcccgctgaggtcccaaaagtccctgatttctaactgctccctcgagttcagaaccatcaaagacaaagacggcaacggacaaataatctacctaaaagccatacctaagagcaacccatattaccaagagttccgcgtttggcaatggctatacaacctaaaaatcttcacgaaagaagacgacaaagacgtcacgaatcagttcatcaataaagtggaagacctggaagcactatttgagttcctcatgaaccaaaaggaagtaaaccacaccgacatactgacatacctaatagaaccaatagtgaaaagtaaataccccaatgccaaaggcaaagccttcaaagatgaactcaagaaggaacttaaaaagtaccgctggaactacgtatacgacgcagacaaagacgaaagcaagtcctaccccatgaacgagacccggtatgaactacgcaagcggctagacaaggtagaaaatgttccggcagatttcatgacgcggaaaatagaacagcacctctggcacatcatatactccgttacggacaaaatagagtttgaaaaggcgctgaaatcgttcgcaaacaaatacgacctacaccaagagagctttgtcgaaaactttaaacgcttcaagcccttcgacagcgattacggcacctattcagaaaaagcaatcaagaaactcctacccctaatgagggtcggaaaatactggtcctgggaaggaatcgacaacaacacaaagaaacgtattggtaaaatcataacgggcgagtacgacgagaccatcaaaaatcgcgttagggagaaagcaatcgacctgacggaggaaaaccacttccaaggactccagttgtggctcgcccagtacatagtgtacgacaggcactcagaagcagacatcgccggaaagtggaacagtgttgctgacctagaacagtacctatcggagttcaaacaacactccctcagaaatcccatagtagaacaagtgataaccgaaaccctccgagtggtacgagacatctggaaacagtacggcaaaggagccaaagactacttcgacgaaatccatatcgagctggggcgagaaatgaaaaacacagccgaagaaaggaagcgactcagcagcatcatatccgaaaacgaaaccacgaacctccgtatacgtgcaatcctcgaggaacttatgtacgacgaaaatatggaaaacgtccgcccctacagcccgatgcagcaggaagccctgaaaatctacgaggacggtgttctcagctcatccgtcgagatccccgaagacatcgagaaaatctcgaaaaagtccgaacccaccaaatccgaaatccaaagatacaagctatggctagagcaaaaataccggtccccatataccggccgccctattcccctcagcaaattattcacaccagcataccaaatcgagcacatcattccccaggcgaggttcttcgacgacggcttcagcaacaaagtcatatgcgagtccgaagtaaacgcactgaaagacaaaatgctcggactagaatttatccagaattactacggccaaaaggttaccaccagcttcggggaggtaacaatactcaccgaagacgcctacaaagccttcgtaaaagaacactacgacaaaaaccgcagtaagcgcaataagctcctcctcgaggaaatcccagaaaagatgatcgatcgccagatgaacgacaccagatacatcagcaagtatatatcgaaggtactcagcaacctcgtccgcggcgagaaagacgatgaaggcgttaactcgaagaacatcatcccgggaaacggcaagatcagcggaaccctaaagcaagactggggactcaacgacgtgtggaatgacctaatcctcccccgattcgagcgtatgaaccagctcacgaacagcacagacttcaccgcctggaatgaaaaacaccaaaaattcctgccgacaatcccgctcgaactatcgaaaggattccaaaagaaaagaatcgaccaccgccaccacgccctggacgctctcatcatagcttgcgcgacacgcgaccacgtcaaccttctcaacaacaaacatgccaaatcccgaaacgaacgctacgacctacagcacaagctccggcacaccacgccctggcaagacaaagaaggaaaggtacgcaccaaatttacagagttcaagaaaccctgggaaacctttacccaagacaccaagaaagagctggagaaaatagtcgtatccttcaaacaaaacctacgggtgataaacaaggccacaaactactacgagaaaatcgtcgacggcaaaaaggtcatgttcaagcaggaaggagtaaactgggccatcaggaaacccatgcacaaggagaccgtgagtggaaaaatagacctcccaagggtgaaagtcagcaaaggaaagatcctaaccgcaacaagaaagtcactagacacttccttcaacgcgaagacaatcctcagcatcacagataccggtatccaaaagatcctcctcaactacctaaaggccaaaggcaatccagaactcgcattctcacccgagggtatagaagaaatgaaccagaacatcagcctgtacaacgacggcaagccccaccaaccaatcctaaaggtgcgagtattcgaacagggatcaaaattccccctaggcgagaccggaaacaagaccacgaaatatgtagaagcagccaagggcacaaacctctttttcggcgtctacgagaacaaccaaggaaaaagaagctacaacacgataccactgaatctggtgatcgaaaggcagaaacaaggacttaactcagtcccagaaacaaacgagaaaggccaccgcctcttattcagcttgtctccgaacgacctcgtctacgtgccaatcgagggcgaggtgttcgacaaaaccaaccccgacgtcaatagaatatacaagatagtctcattcagcgggtcacaaatgttctgcgtacgacaagacgtagcaacgtccatcgtgtataaactcgagttctcctcgctcaataaaatggaacggaccatagacggcataatgataaaggagatatgcatcaaactcaaggtggacaggctaggaaacatatccaaggcgtga

SEQ ID NO: 6852 - RNA, 4323 nt, synthetic construct
  misc_feature 1..4323: note = Cas9 variant
  source 1..4323: mol_type = other RNA
atgaaaacaatattgggcctggacctcggcactaactcaatcgggtgggcacttgtcgaacaagacttcgaaaataaacagggcctaatcctgggtatgggttccaggataatacccatggacgccggaatcatcggaaaattcgccgaaggatcgagcatctcgcagactgccgaacgcaccgggtacaggtccatacgacgactacgcgagcgccacctactcagacgcgagcgactccaccgcgtcctaaacatcctcaaattcctccccgagcactacgcagcagaaatagactttgaaaagcgattcggccaattcctagcagagacagaacccaagctagcctggaagaagaacgccgaaggcaagtttgagttcctcttccagagatcattcgacgaaatggtcgccgacttcaaagccaacggccaagatatcaaaataccctacgactggacgatctattacctccgcaagaaagccttaacgcagaagatctcaccgcaagaactcgcctggattatcctgaactttaaccaaaaacgtggctactaccagctcaggggcgaagaagaagaagagaacccaaacaaaaaggtcgagttctacagcctaaaaatcgtcgacgtagtcgctgatgaacagcccaacaagaaaggagatacctggtactccctccacctcgaaaacggatgggtctaccgcagatccagcaaaatccccttgtacgactggaaagacaaagtcagagacttcatcgtcaccacagacatcaacgaggacggttcggaaaaactagacaaagacggggaggtcaagagatcattccgggcccccaaggaggacgactggacacttatcaaaaagaaaacagagcaggagatcgaacaattcaaccagaccgtgggaagctacatatatgaagcgcttctcgacaacccgacccagaaaatacgcggcaaactcgtccggacaatcgagcgcaaattctataaatcagagcttaagaaaatactagagaaacaaatagaactccaacccgagctattcacagaggacctctacaacgcttgcgctagggaactctacagaaggaacgtcgcacaccagcaacaactatccagccgggacttcgtatatctcttcctgaatgacatcatattctatcagcgtcccctccgatctcaaaagagtctcataagcaactgcagcctggagttcaggactatcaaagataaggacggaaacggccaaatcatataccttaaagccataccaaaatcgaacccctattaccaagagttccgggtgtggcaatggttgtacaacctcaaaatcttcaccaaagaagacgataaagacgtcacgaaccaattcatcaacaaggtcgaagacctcgaagccctgtttgagttcctcatgaaccaaaaagaagtgaaccacaccgacatattaacctaccttatcgaaccgattgtcaagagcaaataccctaacgccaaaggcaaagccttcaaggacgaactcaagaaagaacttaagaaatacagatggaactacgtgtacgacgcagacaaagacgaaagcaaatcctatcccatgaacgaaacccgatacgaactcaggaagcgccttgacaaagtggaaaacgtgccggccgactttatgacccgcaagatcgagcaacacttatggcacatcatctactccgtcacagacaagatcgagttcgaaaaggcgctcaagagcttcgcaaacaaatacgaccttcaccaggagagcttcgtagaaaacttcaaacgcttcaaacccttcgattcggactacgggacttactcagaaaaggcgatcaaaaagctcctacccctcatgcgcgtaggaaaatactggagttgggacatcatagacgataaaacaaaaacccggatcggcaagatcatcacaggcgagtacgacgagaccatcaaaaaccgtgtccgggaaaaggccatcgacctcacggaagaaaaccacttccagggactccaattatggctggcacaatacattgtttacgaccggcactcagaagcggacattgccggaaagtggaacagcgtagccgatctagagcaatacctgagcgaatttaaacaacactccctgcgaaatcctatcgtcgagcaagtaatcaccgagaccctcagagtcgtacgggacatctggaaacagtacggcaagggagcaaaagattacttcgacgagatacacatagagctcggcagagagatgaaaaacaccgcggaagaacgcaagagactcagtagcataataagcgaaaacgaaacgaccaacctgagaatccgagcaatcctagaggaactaatgtacgacgaaaacatggaaaacgtacgcccgtactcaccaatgcagcaggaggccctgaagatatacgaggacggcgtgctaagttcaagcgtagaaatccccgaagacatagaaaagatatctaagaaaagcgagcccaccaagagcgaaatccagcggtacaaactctggctagaacaaaaatatcgatccccatacaccggacgaccaatcccactctccaaactgttcactccagcctaccagatcgaacacatcataccccaagcccgattcttcgacgatggtttctcaaacaaggtcatctgcgaatccgaggtaaatgccctcaaggacaaaatgctcggcctcgagttcatacaaaactactacggccaaaaggtcacgaccagcttcggagaagtcaccatacttaccgaagacgcgtataaggcattcgtcaaagaacactacgacaagaaccgctccaagcggaacaaactactgctcgaagaaatccccgagaaaatgatagaccgccaaatgaacgacacccgatacataagcaaatatattagcaaagtcctttctaacctagtccgaggggaaaaagatgatgaaggcgtcaacagcaagaatatcatccccgggaacggaaagatcactggaatcctaaagcaggactggggactaaacgacgtctggaacgacctaatacttccccgcttcgaacggatgaaccaactaaccaacagcacagacttcacggcctggaacgaaaagcaccagaaattcctacccagcgtacccctagaactcagcaagggcttccaaaagaaaagaatcgaccaccgccaccacgcactcgacgctttaatcatcgcatgcgccacccgcgaccacgtcaacctcctaaataataaacacgccaagtccagaaacgagcgctacgacctacaacacaaactaaggcacaccaccccctggcaagacaaagagggcaaagtaaggacgaaattcaccgaatttaaaaagccctgggaaacattcacgcaagacaccaagaaagagctggagaaaatagtcgtgaacttcaaacagaacctgcgtgtaatcaacaaagccacgaactactatgagaaaatcgtagacgggaaaaaggtaatgttcaaacaggaaggagtcaactgggcaataagaaaaccaatgcacaaagaaaccgtgtcgggcaaaatagacctcccgagagtcaaagtcagtaaaggcaaaatactcacggcgaccaggaaatccctggacacctcattcaacgccaagacaatactctcaataaccgacacaggaatccaaaagatcctcctgaactacctaaaggccaagggaaatcccgaattggctttcagccccgaaggtatagaagaaatgaatcaaaacatcagcttatataatgacggtaaaccccaccaaccaatactgaaagtgcgcgtcttcgagcaaggctcaaagttcccactcggggaaaccggcaataagaccacaaagtatgtagaagcagcaaagggcaccaacctatttttcggcgtctacgaagacaaccaaggaaaaagaagctacgacacgataccactgaacatcgtaatagagagacaaaagcaaggtctgaactcagtgccagaaacaaatgagaaaggtcaccggctcctctttagcctatcgcccaacgacctcgtctacgtccccatagaaggtgaagtcttcgatgagacgaaccccgacgttaacagaatctacaaggtcgtatcattttccgggtcgcaaatgttctgcgtccgccaggatgtggccaccagtatagtctacaaactcgagttcagcagcctcaacaaaatggaacgaacaatcgacggaatcatgataaaggaaatatgcatcaaactcaaagtcgaccgcctgggtaatatctcaaaggcatga

SEQ ID NO: 6853 - RNA, 4332 nt, synthetic construct
  misc_feature 1..4332: note = Cas9 variant
  source 1..4332: mol_type = other RNA
atgataaaactcctgtatctagagaaactcaagcaatacaccatgaagaaaattctaggcctggacctaggcacaagttccatcgggtgggccctggtcaacgaagcagaaaactccgacgaagtcagctccataatcaaactgggcgtaagagtcaatccactaacggtcgacgaaatgcagaatttcgagaagggaaagagcatcaccaccaacgcagaccgcacactcaagcgctcaatgcgacgcaatctccaaagatacaaactcagaagagacgcactaatagaacttctaaagaaagtaggcttcatcaccgacaagacaatcctcagcgaacagggtaacaggaccaccttcgagacttaccgactccgtgcgaaagcggccgaagaagagatcagcctaaaagaactagcacgagtcctactaatgatcaacaagaaacgtggatacaaatcctcacggaaggcgaaaggcgaagaagagggggctctcatagacgggatggagatagcgaaaaagctctacgatgaggacctgactcccggccagctgtgcctgcagctattagaatcgggcaagaaattcttcccggacttctaccgctcggacctgcaagaagagttcaacaaaatatgggacttccagaagcagtttaacctcttcagcttctgcgatgtagcaaaagaggaggtcaaagggaagaacaaaagccaaacatgggcgatcctcgcgaaatacttcgtagaaaccaagaaagtgaacgtctggaacgaacacgaggcgcagacagaaaacagagaggaagtctacaaactggtaggactaaaacgaaccgtcaaaggggaggagctcaaaaaggagaactatcgatggagagtacaagcgctaacggaacaactggacctagagaaaatcgctgtagtgctacaagaaattaacggccaaatttccgccagctccggatatcttggagcaatctccgaccggagcaaggtcctgtacttcaaccgtcaaacggtcggacaataccaaatggccgagctcaacaaaaaccctaacatgtcgctcagaaacatggtcttctaccgacaggactacctcgacgagttcaacgtcatctgggaaaagcaggccgagtttcataaagagctaaccccggaactcaagaaagagatacgagacatcatcatattctaccaacggcggctcaaatcgcaaaaaggcctaatatcattctgcgagttcgaaaaccgagaggtcgtcgtagaaaaagaaggaaagaaacaaaccaaaataatcggctgtaaagtcatcccacggagccatcccctgttccaagagttcaaaatctggcaaaccctgaacaacatagaagtatttgtgggcgagaagaaaggaaaacgcaagaaatcaaacgtcagtagcgacctcttcggggacacggaagacgcactgataaccgaaggacgacggttcctgtaccaggaagaaaagaaaatactggccaaagaactatcaatcaagaaaggcctaaccaaagcagaaatactccgcctccttttcgaaaacccccaagagctggacatcaacttcaaacaaatcgacggcaaccaaaccgggttcgccctattttcggcgtacagtaacatgatcgagaaatacggatacgaacccctcgactttaagaaacccgcggaggacctcatttcccaactaaaaactgtttttacagacctgggctggaacaccgacctcctattcatcgatctagacaaagaaaacaaagaatgggaaaaacaaccgtacttcagattgtggcatcttctatacagttttgaaggggataacaccccaacagggaatggcaaactcatcgagaaaatcatgcaactatgcggtatagaaaaagagtacgcaatcgaactagccaacgtcagcctgcaggacgactacgggagcctctcggcaaaagccataaagaaaatactcctgtacctcaaagaaggcaaccaatatgacatggcatgcgaatacgcaggataccgccactccaaaagctccctaacgaaagaagaaatagaaaacaaagtgctaaaggacaaattagagatactccccaaaaactcgctacgaaacccagtcgtagagaaaatcctgaaccagatggttaacgtcatcaacacagtgatggaagtatacggcagaccggacgaaatacgcgtcgaactcgctcgagaattgaagaaaagtgcgaaagaacgagaggaactaacgaaggccgtagccaaaaacacccgcgaacacgaggagatacgcaaagtattgcagtcagagtttggcatgataaatgttagccgcaatgacatcataagatacaagctgtatgaggaactcaaagacaacggttacaaaacgttatacagtaaccaatacatcccgcgggaaaagctgttctcgaaagaaatcgatatcgaacacatcatcccccagtcccggctgttcgacgactccttgagcaacaaaaccctggaatacaaatcaattaacatcgaaaaaggaaacaagacagcatacgatttcgtaaaagagaagtacggagaagagggcctacagcagtacctcaaccgctgcgaaaacctctgcaaagataagaaagcaaaactcagaaaacttaaaatggaactcaacgagataccagacggtttcatcgatagagacctgcgaaacactcagtacatagccaagaaggctctgagtatgctcacagaaatatgccgacgcgtagtggccaccaccggaagcatcacagacaaactaagggaagattggcagctagtagacgtcatgaaggagctaaacctacccaaatacgaggcgctaggtctggtggaggtctacgaagataaagacgggaggaagatcaagcggataaaagattggaccaaacgcaacgaccaccgacaccacgccatggacgccctaacggtcgccttcaccaaagacgtcttcatacaatacttcaataacaaaaacgcagcctgggaaagcgacagcaaagagcacactaacattgttggaatcaaaactcgctacttcgaatcaggaaaagccgtgcccccgatccccctgggccaattccgcgtcgaggccaaatgtcacctagaaaacctcctcgtatcgataaaagccaaaaataaagtagtgacgacaaacgtcaactgtataaagaagaaaggaggtacctacaaaaacacccaacagaccccacgcggacagctccacctcgaaacgatatacggaagccacaaccaatatgtcactaagatagaaaaggtaaacgcatcattcgacgccgtgaaaatcgccaccgtcagcaaacaggattaccggaacgcgctactaaagcgcctcgaagtattcggtaacgacccgaaaaaggcctttacaggtaagaacagccttgagaaaaacccgatctacctagatagggcacaaacgatacaagtcccggataaggtccaaaccgtcgaactcgaaacagcgtacaccattagaaaaccggttgacccaacactcaacgttgacaaagtggtagacaaaaagatccgactgatcctcgaacaacggctgaaagaatatggcggagatgcaaagaaggctttcgtgaacctcgacgaaaaccccatatggctaaacgaagaaaaaggcatatcgataaaacgggttacgatccgcggcatctccaaggcacaggcgctccacgacaagaaagacaaagatggcaactttatcttagacgaaaccgggaaaaggataccggttgacttcgtcaacacgggcaacaaccaccacgtagcgatctaccggaaacccgtacttgacaagaaaggccaggtcatattcgacgacgaaggtaaccctatgtacgaacttgacgaggacgtagtccccttcttcgaggcagtaaccagagcgaacctcggcatccccatcatagacaaagactacaagaaatccgaaggctggcagttcctcttctccatgaaacaaaacgaatacttcgtattcccgaacgagaaaaccgggttcaatccgaaagaggtagaccttctcgaccccgacaactacgctatgattagcccgaacttattccgcgtccagaaaatcggactcaacgactacacttttcgacaccacctcgaaaccacaatacaaaatgacctcaaattcatcacctggataaggtgtggaaaatcaggcataaaggacatcgtgaaggtcaggatcaaccacataggacaaatcgtaagcgtcggtgagtactga

SEQ ID NO: 6854 - RNA, 4332 nt, synthetic construct
  misc_feature 1..4332: note = Cas9 variant
  source 1..4332: mol_type = other RNA
atgaaaaagatactaggcctcgatctgggtaccgcctctatcgggagcgcatatgtgctcgaagctgagaagtcggcagatcaaaccaaaatcgtctaccttggtacccgaattatcctctcctccgcagacgccgagaacttctccaaaggcctcagctgctccccaacgactgaccggacatttaaaagatccatgcgtcgcagactgcagcgatacaaacagaggcgctcaagcctcatacaacaattcaagaaaataggtatcataacaaacacagagcaaattatccgtgagcctatctcagaaacccacgaactactacgcatccgcagcaaagcagtatcggaacacgtctcattagaagagttcgcccgtattctcctcactatcaacaaaagacgtggatacaaatcaaaccgcaagacttccaaatctaccgaagaagatggtaaactcgtagacgccatggccgtcacgaaggagttaatcaaacttaagaaaaccccaggacaatacatgttcgaacgctttaaacgtggcaaatacgctgaaatcgacttctacccctttgacctcatcaatgaactcaaacagatctgggaagttcaaggccaaaaatatccggacgtactaacggaaggccttctttcctccctattgaaacagaaaacaggaaaagcaaaggaactaatctactcaaaatccgacctaaatcccgcggaagtgccgatagattaccagaaaggcaagaagctccgcaagacaatactaaacaaatatttcgcatacgaatcccgatcactcgccgtcacaaatatcatcccagtggaacaagccattacagcgatcgtcgccatttgcaagcagataaacaactccagcgggtacctaggcgcgataggcgaccgcagtcgcgtcctctatgccaacaaccaaaccatcggtcaatacctatacgagagaatcaaagcaaacccacacgaccgcataagaggcgaagtattctaccggcaagactacctagacgagttcgacagaatttgggagtgccagcaaaactactacccagcaattctcacaaacgaccgaaagcagtacatccgcaatcggatcatattctatcagcgccccctaaagagcaagaaatcagagctagcattctgtgagttcgaatcccgcgaggtagaacataacggtaagaaatacacggaagggctacacgttgcaccgaaaagttcccctgttttccaacacttcagactctggcagagactcggccagatcgaggtgagcccactccgaaaatgggataaacaatcaaacgaactgttcgaacaacaaaacaacgccgaccgggagggcatactgaacaccgaggcaaagcaaaaactcttctcctacctgaacctcctagaccacttgactgataacgagatcctcaacatcctcggatacagcccagacaagtggaaaataaacttccgcgagatcataggcaaccgaaccaacaaccttatgatgaaagccttcttcagcatgaaggaaatgaccgatggggagcaaatagactgggagaaaaacctaaccaaaatcaccaacggccagagcctgatctcaccagaacaaatagtagacctcataaggcaattcttcgaacgcgaaggcatcaccacatcattactatacttcgaccccgccaccgataatttccgggagcagagccactactcgttatggcacctcctatacagctatgaagacgacaactcgccaacaggcaccacctccctctgcaagacgctagccaaacggtacggcatcccccatgaactgtgtcccctgttagccagcctaacattcgagaggcagtacggttcactctccaccaaagcaatgaggaaactgctcccgtttatgcaggaaaagcgctacgatgaggcatgcgaactagctgggtatcgccactcagcatggattacgaaggaggaaaacgccaagaggaccctcaagaacaaactcccactcctcagaaaagggtccctccggaatccagtcgtagagaaaatcctgaatcaaatgacccacgtgatcaatacccacatcgcggaatacggaaatcccgacgaaatccggatagaaatggcacgcgatatgcaagccaactccaaacagagaaaggccatgacagcggccataaccgaagccacgaaacgcaatacgcagttcatcgaagagatacagaaagagttcggcttcaacccatccaaaaacgacctaataaagtacaaactatggaaagaactagcacccctgggaaacaagaccctctactcaaacatctacatcccgaaggaagaactattcacagccaaatttgaaatcgaacacatcataccacgcgccctcttctacgacgactcctttagtaacaaaaccctcgaattaaacagcgtcaacaaactgaaaggcaataaaactgcactagactacctagacaccctcggacaagagaaagccaacgattacatcctaagagtagaagaactgaagaaaatcggggcaataacgcaagccaaatacaagaaactcctgatccgcgagaaagacctaggagatgacttcaccaaccgcgacctaaccaacacacggtacatcatccgccacgccgcggaccgcgacctgacaaacacacgctacatcatccgacacgcggcagacatgctgctgcaggtaacccccagcatcgtccacaccaacggctccataaccgcaatcctgagacgagactgggggctcctggacatactcaaagaattaaacctcccgacatacgaaagcattgaccgcaagatatcagacccagaagaaaaactcacacaatccgttgatcgaaaagacggccaagcgattaaaatgatcaaggactggagcaaaagagatgaccatcgacaccacgcaatggacgccctcatcacagccttgacgacaagaaagcacgtccagtacctaaacgggaactcgggcgccgaagaaacggacaaagcgcaaaaacttgaacaactcaaagctctccgcaagcaactgattggcagcgacggacacttcatcccaccaatgcacgacatccgagtacaagctaaagaagccctctccagagtcatcatctccaccaaagttaagggcaaagtcacaaccccaaacactaacatcatatgtagcagagacaaaacaacaggcagaaaaatatacgtccgccaaaccactctcacaccccgcggcgcattacacctagacaccaaatacggaatcaacagatactaccaggagagggaggtctcgataggtagcaagctcacccaggaagagatccggctcgtatcctccccgcacatccaatcaatcctactcgaacgactacgtgccttcgacaacaacccgaagtcagccttcacgggtcgcaactctgtagataagaaacctctcgaagacaaaaacaagaaactcgtctacaccgataagaaagtgaaacaaaccatacttgcaaaccgctttgtaaagcgcgaccgagtgaactccaaactggacctcgacaacgtaatagacacgggcataaaacgcatcctcgaacgccgcctcaaacagtacggaggaaaatatgaaacagccttctcagacctcgaaaacaatcccatctggctcaacgaagaaaaaggtatcgccatcaaatctgtccgtatacgcgggaaaaacaacacaatcaccatccgccaaaccaacacatgccgaataaagtacgtggccaacgacaacaaccaccacctagccgtctacgcactgcctgacgggagcatcaaggacgacatcgtatcattcttcgacgcagtagaaagatcccgcaaacgccttccaataatcgacaaacataaaaaccaatctctaggctggaagtatctattcagcatcaaacaaaacgagtacttccttctaccccaacaggtcgagaaaattgacatagacacgggggagatttccatgcaaacaaccttctcgcctaaagacttatcccacgaatacataatgaatcccgacaattacgccgagcttgcaagccacattttccgtgtccagtcaatcagcaaaaccccacagggaaacagagacgtccgcatctacctcttcaaacagcaatacatctcgggtagccaaaaggacagcctacaccttaaaggaataacccacagacaaatttcctccgccaaagacctagccgagctggtaaaaatacgagtgaaccacctcgggcgcatcgtatcagtcggagaaaaatga

SEQ ID NO: 6855 - RNA, 4341 nt, synthetic construct
  misc_feature 1..4341: note = Cas9 variant
  source 1..4341: mol_type = other RNA
atggtcaagaacatcctgggcctcgacctgggaacgaacagtgtgggctgggccctaattaaacaagactttgagaacaaacaaggagacatcctcggcatgggatcccggatcatccccatgtctcaagacgtcctaggcgacttcgggaagggcaattctatatcgcagaccgcggaacggaccaagtacagatcggtgagacgcctgagggagcgctttctcttgagacgagagcgcctccaccgagtactaaacgtcctagattttctaccggagcactacgcaagccagatcgacttcaataaaagattcggaaaattcaaagaggagaccgagccgaagctcgcgtactcaaacgacggattcatattcaagaaatcttttgaggaaatgatctcggacttcaagacccatcagcccgaactcctagaaaacaataagaaagtcccctacgactggacaatatactacctgcgaaataaagcactctcgcataaaatcgaaaaagaggaactagcgtggatcctactcaatttcaaccagaaaagaggatactaccaactacgcggtgaagaagaagaagaaaacccaaacaaactgatcgagttctacagcctcaagatagttgacgtactagccgacgagccgcagaaaggcaagtccgacatctggtatagcctcatacttgaaaatggatggatctaccgtcgatcctccaagatccccctactcgattggaagggtaaaacacgcgacttcatcgtcactacagacctaaacgacgacggatccgtaaagaccgacaaggagggcaatgaaaagcgatctttccgcgccccgggtgaaaacgactggaccctcgtcaaaaagaaaaccgaacaagaaatcgacaactccgacaagacggtaggagcatatatatacgaagctctcctacagaaccctaagcagaaaatcaagggtaagctcgtacgcaccatagaacgaaagttctataaagcagagctaaaacaaatcctagaaaagcaaatggagttccaccccgaactccgacaagacgatctctatagcgactgcgtccgcgagctctataaaaacaatgaagcccatcaactcaccttgtcgaagaaagacttcgtccatctattcatggaagacatcatcttctatcaaagaccactccggtcacagaaaagctcaatctcaaactgtacactagagtttcggaagtacaaagacgagaacggaaccgaacacattcaatacctcaaggcactccccaagtccaacccatactaccaagagttccgaatatggcaatggatgtacaacctaaacatatacaagaaagaggacgacacaaacgtcaccaaagaatttctcaactccaaagccgatttcgaaagcctattcgagttcctcaacaacaagaaagaagtggaccaaaaagctctactcaagcacttcaaaatcaacgataaaactcaccgatggaaatacgtagaagacaagaagtatccctgcaacgaaacgaagaccatgataagcgaacgattaaagaaagtcgagaacatatccgatgactttttaacccgcgaaatggaacaaaagatatggcacatcatatacagcgtcaacgacaaggtaaaatacgaaaaagcgctcaagtcattcgctgagaaaaacaacctcgacgaatcgtcctttttcgaagcattcaagaaattcccacctttcaagtcggaatacggagcgttctccgaaaaagcaatcaagaaactactgcccctaatgcgcctaggaaaatactgggacgacgacgaaatcctcaaatacagcgacatatacttcaaaaacatcgagtaccttctgggcgtgctcaagcaaaaggacaaaaacatatccgacgacaacaggcaaaactggaacaagtcgatcaacaacaagctgcgagaagaactcgagatattccaaaacgcggagatcgagtcatttcaaggattacgactccacatagcacaatacatcctttatggccgacactccgaggccgcaatgctaggcaaatggaactcggccgacgacctagaggaatttctaaaggagttcaagcaacacagcctaaggaatcctatagtcgaacaagtaatcaccgagaccctccgtgttgtaaaggacatctgggtcaagtacgggaacggcgccaaggacttcttcaacgaaatacacatcgaactcgggagggaaatgaagttgcccgcggaagaccgaaagaaaattaccaaccaaataagcgaaaacgagaacacaaatctacgaatcaaggctttactagccgaaatgatggtagattcgtctgttgagaacgttcgacctttcagccctatgcaacaagagatcctgaaaatctacgaggacggcgtcctcaactcggacatcgaaatagaggacgacatcctgaagatctctaaaaccgcacaacccagtcccagcgacctcaagcgctacaagctatggctagaacaaaagtacaaatcaccatataccggccagatcatacccctaaacaaactcttcacgcctgagtacgagattgaacacattatcccgcaaagccgttatttcgacgactcattcagcaacaaagtcatctgcgaagctgcagtgaacaaactaaaggataatttcatcggactaggcttcataaagcaattcggaggaaccatcgtcgaatgcggcaacggcaagtccgttacagtgctaaaggaagaccaatacgaagacttcgtcaagaaacactacgccaataaccgatccaaacgaaacaaactcttactcgaagacatcccagaaaagatgatagagcgccaaatgaacgacacacggtacatcagcaagtacatcagtggagtcctaagcaacatcgtcagaacagaggacggcacagacgacggcgttaactccaaaaacatagtcccaggcaacggaaagatcacgaatacgctgaaacaggactggggcttaaacgacatatggaacgacctcatcctaccgaggttcgaacgcatgaatcagttgacaaacagcacagacttcaccgcctggaacgaaaaccatcagaaattcttacccacagtcccagtggagttcagcaaaggattctccaagaaacgcattgaccaccgccaccacgcgctcgacgccctggtaatagcatgtgcaaccaaagaccacgtcaacctcctcaataaccaatccgcaaaatccgacacgaaaagacacgatctgaaacgaaagctcatgaaattcgaaaaggtcgcctacaaccacccacaaaccggcgagcgcatcgaacgcgaagtcccaaaacaattcctaaagccctgggaaacattcaccgttgaggcaaagaatggattggaaaccatcatcgtctcgttcaaacaaaacctccgagtgatcaacaaagccacgaaccattacgagaaatacgtagaaaaagacggcgccaaagtcaaaggacgcgtcgagcaagcaggaacgaactgggcgattcgcaagccgatgcataaagaaaccgtatccggaaaaatagacttgccgcgaatcaaagtgcccaaaggtaaaatcctcacggccacgcggaaaaacctcgacactagcttcgacctcaaaacaatcggaagcatcacagacaccgggatacagaaaatcctcaaaaattacctacagtacaaggacaacaacccagaattagccttctcaccagaaggaatcgaagacatgaacaaaaacatagagaaattcaacgacggcaaagtccaccagcccataatcaaagttcggatattcgagctcggctccaaattccccctcggccaaagcggcaacaaaaaggacaagtacgtcgaagccgcaaaaggcactaacttattcttcgccgtatatgaggacaaaaacggaaagagatcatacgagaccatcccactgaacgaagttatcgaacgacaaaaacaaggactgactgttgtggacctgaaaggagtgaacgacttctacctatcccccaacgacctggtgtacgtcccaagcgaagacgagctagagaacgtctccatgatcgactacaacaagctatcgaacgaaaaggtgtacaaagtagtcagtttcaccggtaaccaaatattcttcgtccgacaggacgtcgccaccagtatagtaaacaaggccgagttcagctcacttaacaagatggagcgggccatcgggggaaccatgattaaagaggtattcgtaaaaataaaaatagaccgcctcggcaatatcagcaaggtctga

SEQ ID NO: 6856 - RNA, 4347 nt, synthetic construct
  misc_feature 1..4347: note = Cas9 variant
  source 1..4347: mol_type = other RNA
atgaaacacatcctggggctagacctgggaacaaactccataggctgggccgtagtaaaagaggcccaaaacgacaatgaacaaagcgaaatagtcgacgtcggagttcgcgtaaatcccctgaccaccgatgagaagacaaacttcgagaaggggaaaccaatcagcacgaatgcagacaggactctcaaacgatccgcccgccgcaatctgcaaagatacaaactgcgacgcaaagaactaatcgaactactcaaagaacaccagctgatatcagagaacaccatactcacggaaaacggaaagggcacaacattccagaccctagagctacgtgccaagagcgcgaaagagaaaatctcactcggcgagttagcccgcgttttcctcacaatcaataaaaagagaggctacaaatccagcaggaaggccaaaaacggagacgagggacaacttatcgacggaatggagatcgcgaagcgactatacgaagagaacctcacgactggacagctttcgctccagctcctaaaggaaggaaagaaatcactaccggactactacagatcagacctacagttcgaactagacaaggtctggaacttccaaaagcagagtcactccgatatactcacggacgagttctacgcacaactcaaaggcaaagggcaacgcgctactagcgccctcttcctggcgaaatatcagatctacacggctgaaaacaaaggatcccgagaggacaagaaactacaagcctaccaatggcgagtcgacgccctatccaaggaactgacccgcgaagaactcgcgttcgtcatcaccgaaatcaacaacaacctaaacaactcaagcggttacctcggagcaatcagtgaccgctcgaaagaactctacttcaacaatgagaccgtaggcgaatacctctggaaacagatcgccgcgaatccccacaactcactgaaaaaccaagtgttctatcggcaagactacctagacgagttcgaacaaatctggaagacgcaatcagctttctaccccgaaatccttacagacgaactgaagaaagagctacgggacgttgtcatattttaccaaagaaaactaaaatcccaaaaatccctagtcagcttttgtgagttcgaaaacaaggaaatcgaaataaagaacgaggacggaaccaccacgaagaaagtgatcggcctcaaagtggcccccaaatccagccccctattccaagagttcaaaatctggcaaaacctcaacaatgtcctaatccgcaaaaagggctcaaaaacaaagaaagtcgccaaaaatcaacaagcggtattattcgaagaagagaaaaccatatctgaattagaccttgaagcgaaacaggcactcttcaacgaactgaacctcaaaggaaacctcaaagccgactactgcctagaaatcctagggtactcaccgaaagaatgggaaatgaactactccattctcgaaggaaaccgcacaaacaaagcactatatgaggcctacctaaaaatcacggacctggaggggtacgacgcaaagaaccacctaaaagtgaaacttaacaaggatgaagtagagctcgacgacctcaaagtgccagcctcagaaatcaaggacatggtccaggctatctttaaagaggcaggaattaacactgacatactgcacttcaacgcagaactcgacgggaaagacttcgagaaccaagcaagctatcaattgtggcacctactttactcatacgaaggcgacgacagcaagtcgggcaacgagcttctctacaaactattggagaccaaattcggcttcaaaaaggagtacgcacaaattttggcgaatgttagcctctcggacgactacggaaatctcagtacaaaagctatgcgggagattataacccacctcaaacaggggttccccttcacaggccgcaaggaccgcccggacgagccatccgcgtgcgagttcgcgggctataaacactccaaacactcgctaacgaaagaagaaaatgagaagcgcgtcctgaaggatagcctggaggtactcaaaaagaacagcctgcgccaacccgtcgtcgaaaagatcctgaaccaaatgatcaacctggtcaacgcgctgctgaagaaataccggacagagaatccaaacttcaaattcgacgagatacgcatcgaactagcgagagagctcaaaaagaaggccgaggaacgcgctaacatgaccgcgaatatcaacaaggctaaaacggagcacgagaaaatcataaaaatactaaagaatgagttcggactaccaaacccgacgcggaacgacattatacgctaccgcctgtacgaagaattaaaggataacggatacaaagacctatataagggcgactacatcccccgggaaaaactcttcagtaaagaaatagacatagaacacatcatccccaaagcccgagtgttcgacgacagcttctccaacaagacaataacctacaggaagacaaacttggaaaagggcgaacgcactgcgtatgactacatcgagtcccttggcgaaaagcaactagaggagttcctaagccgcatagaaaacctatacgaaatcgggaaaccctcgcgcctccacaacagacgaaatcccctaaagaaagtggaggaaaaaggcatcagcgacagtaaatacaagaaactcctgaagaaagagagcgaaatcggcgacgggttcgtcgagcgtgatctacgggaaacacaatacatcgccaagaaagccaaagagatcctacttcagataacgcgcagcgtgctctccactagcgggggcatcaccgatcgcctccgcgaagattgggacctaatcaatgtgatgaaagaactcaacctgccaaaatacagagccctcggcctgacgaaaatggaggatcgtaaatacggccaacaggtcgaggtcataacagactggacaaaacgaaacgacctccgccaccacgcaatggatgcactaacagtagcattcaccaaacacaatcacatccaatacctaaactacctcaatgcgcggaaaaacgaaaaacataaagaacacaacaatataatggccatacaacaactagaaacaatcaaagtcacggacgaaaacggcaacgaaaaacgtatattcaaagcgcccatgcctaacttccgacaggtggccaaagcattcctcgaaaacgtactcatatcgcacaaagccaaaaacaaagtagtaaccaaaaacaagaacaagatctccggcaacaacaaagtacaagaagtgctcacaccgcgcggacaactacataaagagacaatttacggaaaataccagtactacgtacagaaagaggagaaaatcggcggtaaatttgatctggaaaccatagaaaaagtagccaaccccctgtaccaaagccttttgaagaaacgtctcgaagaaaacggcggcgacccaaagaaagcgttcaccggcaaaaacagcctcgctaaaaacccgatctacctcgacgaagcacaaaccgaacagctaccggaaaaagtaaaactggtatggctcgaaaactcattctccattaggaaagacatcacaccggagaacttcaaagacgagaaactgatcgacaaaatactcgacgaaggcgtcaaacggatactaaaagagcggttacagtccttcggcaacgacgcgaagaaagccttcagcgacttagagaaaaacccgatatggctgaacaaagaaaaaggtatagccataaaaagagtaacaatctccggcgtagcaaatgcagaaccgctacacacgaagaaagaccacctcggaaaagaaatcctcgacaaagagggtaaacccatccccgtcgattttatcagcaccggatccaaccaccacgtagcagtctatcgcgacgaaaaaggaaacctccaagagaaggtagtgagtgtattcgaagcagtcgtacgagcgaaccaaggcctcccaatcattgacaagacatacaatcaatacctcggctgggagttcctattcagcatgaaacagaacgagatgttcgtgttccccaatgagtcaactggcttcaacccgaacgacatcgatctactggaccccaagaacaagaaaataataagccccaacctctttagagtccaaaaactggcgacaggcgactactggttccgacaccacctagagaccactgtcgagacaaaaagcgcaacgaaagatatgacgtacaaaagactcagcctcaaccacatcaaaaacataatcaaagtccggataaaccacctaggcgatatcgtgagcgtgggagaatactga

SEQ ID NO: 6857 - RNA, 4353 nt, synthetic construct
  misc_feature 1..4353: note = Cas9 variant
  source 1..4353: mol_type = other RNA
atgaaacacatcctggggcttgatctcggaagcaactccataggatgggctttcgtccagcaggactttgagaacaaacaaggcaagataatcgcaaccgggtcccgcataatccccatggaccaggggatactcggtgacttcgaacgaggcaatactgtaagccaaacagccgaacgaacgacctatcggaacacccggcgactccgagaacgccacctactccgccgggaacgattacacagagtactacacatcctaggcttcctccctccccactacgacagccagatcgacttcaccaaaagatacggcaaattcatcgacaacgccgaaccaaaaattgcttataacaacggaaacttcattttcatgaactcgtttaacgaaatgattgaggacttcaagaaataccagccacaactgttctacaagaaatcaaacggcgaagaatctaaaatcccatacgactggacaatctactacctccgcaagaaagccttatcccagaaaataacccaacaagaacttgcctggctaatactccacttcaaccaaaaacgcggatactaccagctacgcggcgaggaagagaccgagaacccaaacaaagaggtggccttccactccctcgaggtcgtagatgtagaagccgaggccccaaacaagaaaggagagatatggtacaccatccggctcgagaacggctggatataccgaagaaccagcaaaatccccctcgacgactggaaaggcaaaaccagagacttcatagtcacaacagacctcaacgacgacgggacgataaaactcgacaaggagggcaaagaaaagcgttcgttccgagccccggatgaaaacgactggaacctcctcaaaaagaagacagaacacgacatcgacttctcagggaaaacagtgggagcatatatttacgaccatctactacaaaaccccaaccagaaaataaaagggaagctagtccgcaccatagaaagaaagtattataaagacgaactaaaagccatactagccaaacagatcgcgctacagcccgaattattcacggaaacgctcctcgcagactgcattcgagaactataccgcaaaaacgaaacccaacagcagaacctcctctcgaaagacttcctccacctgttcgtcgaagacataatattctaccagcgcccactacgctcgaaaaagtccacaatcgcgaactgtacccttgaaaagcgctcctacatagacaaggaaaccaacgagcgaaaagacacgcccataaaagtatgtgcgaaatcaaacccgtattaccaagagttccgcgtcctccagtggctccagaacctgcgcatctacgaaatcgagaccgacagggaggtcactgcagagttcattgaaaccgcccaagacaacgaggccctcttcaacttcctcatgtcccagaaagaaatcgacaatgaaagtctcctcaaatacttcctctttgccaaaaatccgcaaataaaggacaaggtcgcgaaatccgaactaaagaagtggctgacaacataccggtggaactacgtgtatgacgcggcagataacagtagcaagaaataccccatgaacgaaaccggctacgagctccagcaatacctacaaaaagtggaaggactacctgcaaacttcctaacgtttgacatcacatacagactgtggcacctactttactccgtaaaagacaaagtggagttcgaaaaagcccttaagaaattcgcgcaagaataccaactggacgaagcgtcatttgttgactcattcaagaacttcaaaccctacccgaatgaatacgggtcctttagcgaaaaagccatcaagaaactcctaccactcatgcgcttcggaaaccattgggactttaataggatagacgtatcaacccaaaaacggatagacgacctaatcaacggcgtagccaatgacgaaatcagaacaataatacgcgagaaggccgaaaaatatcaactgaacagcgaaacatgcttccaaggcctacccctatggctcgcacaatacgtggtgtacaatagacacgcagaagccgctgacatcgaaaagtggacaagcgtcaacgacctcgaagcatatctagaagacttcaaacaacacagcctcagaaacccaatcgtagaacaagtcatcacagaaacgctgagagtcgtgcgagacatttggcaacgatacggcggcggccaggcaaacttcttcgacgagatacacatcgagttaggacgagaactaaagaaaacagcggaggaaagaaaacaactgagcaaccgcaaccaggaaaatgagaacacgaatcttcgtatcaaaaagctcctcgccgaactgaaagaggacgcgagcatacaaaacgtaaggccttacagcccggtccaacaggaattactgaaaatctacgaggaaggagtcttcagcgccaccgacgaagtggaagaagatatccagaaaatcaggaaaaaggcagaaccgacaacccccgagatccaacgatacaaactgtggcttgagcaaaaatataaaagtccctacacaggagaagttatctccctaaccaaactctttacggaggagtacgagattgaacacatcatcccacagagccgatactatgacgactccctatcaaacaaagtgatatgtgaaagcgctgtgaacaaactgaaaaccaatcagctgggcctagagttcatccaaaaccaccacggcgaaaaggtccgcatcaccgccaacaaggaggttaccatattcaccgaagaacaatacaaggagttcgtgaagaaacactacgcgaacaactccgcgaaacaacaaaaactcctactcaacgaaatccctgaaaagatggtcgccagacaactcaacgacacgcgctacatcagcaaatacatcagcgaaatactatcaaaaatagtccggagcgacgaaaaagatgaaggcgtaaacagcaaaaacatcatcccctgcaccggcaaaatcacaaccgcactaaaacaggactggggactgaacgacgtttggaacgaactaatcctcccacgattcgagcggatgaatcaacttacgcagactcagctgttcacctcatacaacgacagattccagaaaaacctaccaactgtcccaattgaatactcacaaggattccagaaaaagcgcatagaccaccgccaccacgcgatggacgctctggtgatcgcatgcgcaacccgcgaacacatcaactacatgaacaaccaacatgccctagacaaaagcaaggacaagaaagaaaaacaacaaagtcgcatagacttgcgcaccatcctctgcgaaaagaagaataacaactggcagttcaagaaaccatggtcaacattcacacaagaagcgcaggaggcactcgaacacattgtagtatcctttaaacaaaacctacgcgtaataaataaagccaccaactattacgaaaaatgggaagagaaaaatggcgtgctagtcaaaaagaaagtgaaacaggagggcaccaactgggcaatccgaaaaccactgcacaaagagaccgtaagtggcaaaatagtcctcgaccgtaaaattggcaaagacaagatcctcacagctacccgaaaatcagttgatatcacattcactgagaaaatcataagctccataaccgatactggcatacaaaagatactgctcaactacctcaaatacaaagggtcgcccgaagtcgcctttagcgcagaaggcctggaagaactgaacaagaacatagctcaatacaatgacggaaagaaacatcaaccgatctataaagtacgcatattcgaagaagggtcgaaatttcccctaggagaaacaggagcaaaagctaccaaatacgtcgaagccgccaaagggaccaacttattcttcggggtctaccaagggaaaggaaaacgaacatacgccaccatcccactaaacgaagtcattgaacggcaaaagcaaggcctgccaagcgtgccagaacgcaacgaaaagggcgagcccctcctgttcagcctctctccaaacgatctggtatacgtaccgatggaaggcgaaatcgcggaaaccattgacttcaacaacctatctaaggagcaaaaggagagaatctacaaaaccgtatcctttaccgggaatcaatgcttcttcgtacaagaagccgtcgccacgccaatagtcaacaaaatagaatacagccccctcaacaaaatggaacgagacatcctcggaacgatgataaaggaagtatgcataaaactcaaggttgaccgcctcggcaatatcacgaaagcctga

SEQ ID NO: 6858 - RNA, 4353 nt, synthetic construct
  misc_feature 1..4353: note = Cas9 variant
  source 1..4353: mol_type = other RNA
atgaaacgcatcctcggactcgacctcggatcaaacagcatcggatgggcgttcgtcgaacaggacttcgagaacaagcagggcaagatcatagccaccggctcccgcataataccaatggaccaaggcatactcggggacttcgagaaagggaataccgtctcccaaacggcggaacgaacaacatacaggagcatgagacggcttcgggaaagacacctcctgcggcgcgaaagactacaccgcgtgctgcacatactcgggttcctgcccccgcactatgacgcgcaaattgacttcacaaaaagatacggcaaattcatcgacaacgctgagccgaagatcgcatacaacaacggaaacttcatattcatgaacagctttaacgagatgatagaagacttcaagaaataccaaccacaactattctacaaaaagtcaaacggggaggagtcgaaaatcccatacgactggaccatatactacctcagaaagaaagtactcagccagaaaataacccagcaagagctcgcttggctaatcttacacttcaaccaaaaacggggctactaccaactcagaggagaggaagagacggaaaacccaaacaaagaagtagccttccattcactcaaggtggtcgacgtagaagccgaggcgcccaacaagaaaggagagatctggtacactatacggctggaaaacggttggatttaccgacgaacgagtaagatccccctagacgactggaaaggcaagacaagagacttcatagtaaccaccgaccttaacgacgatggcaccataaaagtagacaaagagggaaaggaaaaacgatcattccgcgcaccagacgaaaatgactggaacctcctaaagaagaaaacggagcacgacatcgatttctccggcaaaacagtgggagcctacatatatgaccacttgcttcaaaacccaaaccagaaaatcaaaggcaaactcgtacggaccatcgaacgcaagtactacaaagacgagctaaaggccatcctcgccaaacaaatagccctccaaccagaactcttcaccgagacgctcctcgcggactgcatcagagaactctaccggaaaaacgaaacccaacaacaaaacctgcttagcaaagatttcctacacctattcgtagaggacataatcttctaccaacgacccctgagatctaagaaaagcaccatagccaattgcacactcgagaagcgaagctacatagacaaggaaacaaacgaacgcaaggacaccttcattaaggtgtgcgccaaatctaacccgtactaccaagagttcagggtcctgcaatggctgcaaaacctgagaatttatgaaatagaaacagacagggaggtcaccgccgagttcatcgaaacggcagaagactacgaggcactattcaacttcctaatgagccaaaaagaaatagacaatgaagggctactcaaatacttccttttcgcaaagaatccgcaaatcaaggacaaggtcgcgaaaagcgaactcaaaaagtggctcacaacatatagatggaactacgtatacgacgccgccgacaacagttcgaagaaatacccgatgaatgaaacagggtatgacctacagagatatctacaaaaagtcgaaggcctaccggcgaacttcctgaccttcgacatcacctaccggctgtggcacctcctatattccgtcaaagataaggtggagttcgaaaaggctctcaagaagttcgcccaggagtaccaactcgacgaagcgtcgttcgtagattccttcaaaaacttcaagccataccccaatgagtacggcagcttctcggaaaaggccatcaagaaacttctgcccctcatgcgattcggcaaccactgggattttaaccgaatcgacgtctccacccagaaacgtatagacgacctaatcaacggagtcgccaacgacgagatacgaacgatcataagagaaaaggccgagaaataccaactaaactcagaatcttgcttccaggggctgcccttgtggctcgcccaatacgtcgtctacaaccgacacgcagaagcaaccgatatcgaaaaatggaccagcgtcagcgatctcgaaacatacctcgaggacttcaaacaacactcgctacggaatccaatcgtcgaacaagtcgtgaccgaaacgcttcgggtggtcagggacatctggcaacagtacggaggcggccaagcgaacttcttcgatgaaatccacatcgaactagggcgcgagttgaaaaagactgccgaagaacgcaaacaactcagcaaccgcaaccaagaaaatgaaaacaccaatctccgaatcaaaaagctcttggccgaactgaaggaagacgcaagtatacagaacgtcagaccctacagccccgtccaacaagaactcctgaaaatctacgaggaaggcgtattcagctccacagaccaagtggaggaggatatacagaaaattcgcaagaaagccgaaccaacaactccggagatccaacgatacaaactgtggctcgagcaaaaatacaaatcaccgtacaccggcgaggtaattagcctgaccaagctattcacggaagaatacgaaatcgagcacatcatcccacaatctagatactacgacgacagtctaagcaacaaagtcatctgcgagtcagccgtaaacaaactcaaaactaaccaactaggcctggagttcatccaaaaccaccacggcgaaaaagtccgaataacgggcaacaaagaagttacaatattcaccgaggaacagtacaaagaatttgtcaaaaagcactacgcgaacaactccgcaaaacaacaaaagctcctcctgaacgaaatcccagagaagatggtcgcacgccagctcaacgacacccgctacatctcgaaatacatctcagagattctatcaaaaatagtacgaagtgacgaaaaagacgagggcgtcaacagcaaaaacgtcatcccatgcaccggcaagatcaccacagcccttaagcaagattggggcctcaacgacgtatggaacgaactcatactgccacggttcgagcgcatgaaccaactaactcaaacccaactattcacctcatacaacgatcgcttccagaaaaatcttccgacagtccccatcgagtacagccaaggatttcaaaagaaacgaatcgaccaccgacatcacgccatggacgcactcgtgatcgcctgcgccacccgagaacacatcaactacatgaacaatcaacacgccctcgacaaaaacaaggacaaaaaggaaaaacaacaatcgcgcatagacttgaggacaattctatgcgagaagaaaaacaacaactggcaattcaagaaaccatggagtacattcacccaagagacaaaagaagcactcgaacacatagtcgtgagcttcaaacaaaacctgcgggtcatcaataaagccaccaactactatgaaaaatgggaagagaaaaacggcgtcctagtgaaaaagaaggtaaaacaagaaggcacgaactgggctataagaaaaccactccacaaagaaacagttagcgggaagattgtattagaccgaaaaatcggaaaagacaagatccttacggcgacccgcaaggaagtagacataacatttaccgagaaaatcatctccagcatcacagacacaggaatccagaaaatcctactaaattacctcaactacaagggctcccccgaagtagccttctcagccgaaggactagaagaactcaacaaaaacatagcccaatacaacgacgggaaaaagcaccaacccatctacaaggtcagaatcttcgaggagggaagtaagttcccattaggagaaacgggcgcaaaagctaccaaattcgtagaagcagccaaaggaacaaacctcttcttcggagtataccaggggaaagaaaaacgatcctacgcaactatacctctaaacgaggtcatcgaacgccagaaacaaggactgccaagcgtaccagagcgcaacgaaaagggcgagccactcctcttcagcctgtccccgaacgacctcgtctacgtccccatggaaggcgaaatagccgagacgatagacttcaacaacctttccaaggaacagaaggagcgaatctacaaaacggtgagcttcaccggcaaccagtgcttcttcgtccaagaagcggtcgccacgccaattgtaaacaaaatggaatactccccacttaacaaaatggaacgcgacatccttgggaccatgatcaaagaggtatgcatcaaactaaaagtagacaggctcggaaatataacaaaagcttga

SEQ ID NO: 6859 - RNA, 4353 nt, synthetic construct
  misc_feature 1..4353: note = Cas9 variant
  source 1..4353: mol_type = other RNA
atgaaacacatcctaggtctagacctcggctcaaacagcatcggctgggcctttgtacagcaggacttcgaaaataaacaaggcaaaatcatagcagcgggcagccgaataatcccaatggaccagaaaatgctctccaacttcgaagagggcaccacagtaagccaaacagcagaaagaaccacataccgcagcatgcggagactcagagaacgacacctactccgaagagaacgactccaccgagtccttcacatcctcggctttctaccgccccactacgacgctcaaattgacttcacgaaacgatacggaaaattcatcgacaacgcggaacccaaaatagcctacaataacgggaactttatcttcatgaatagcttcaacgagatgatagaagacttcaaggaacaccagccccagctattttacaagaaaagcaacggcgaggaatcaaaaataccctatgattggacaatatactacctccgaaagaaagccctcagccaaaagattacacagcaagagctcgcctggctaatactccacttcaaccaaaaacgaggatactatcagctcagaggagaagaagaaacagaaaatccaaacaaagaggtagccttccatagcctaaaggtagtggatgtcgaagccgaagccccaaataagaaaggcgaaatatggtacacgatccgcctcgagaatgggtggatatacagacgaacatccaaaatcccgttggacgactggaaagggaaaacccgcgacttcatcgttaccaccgacttgaacgacgacgggacgatcaaacttgacaaagaaggaaaagaaaaacgttcattccgcgccccagacgaaaacgactggaacctcctgaagaagaaaacagaacacgacatagacttttccgggaagccagtcgggacttacatttacgatcacctactgcagaacccaaatcagaaaataaaggggaaactcgtacggaccatcgagcgcaagtactacaaagacgaactgaaagccatcctcgcgaagcaaatagcactacaacccgaactgttcaccgagaccctactagcggattgcatcagggaactataccgaaagaacgagacacagcaacaaaacctcctctcaaaagactttctccacttattcgtcgaggacatcatattctaccagagacctcttcgaagcaagaaatcaactatagctaactgcacgctcgaaaaacgctcttacatcgacaaagaaaccaatgaacgcaaagacacccccattaaagtctgctcgaaatcgaacccatactaccaagagttccgggtcctacagtggctccaaaacctcagaatctacgaaatagaaactgaccgcgaagtcaccgccgagttcatcgaaaccgctcaggactacgaagcactgttcaacttcctgatgtcacagaaagagatcgacaacgagagcctactcaagtacttcctcttcgccaaaaaccctcaaataaaagataaaaccgcaaaaatcgaacttaagaaatggatcacgacataccgctggaattacgtctacgacgtagccgacaactcttcaaagaaatatcccatgaacgagacgggatacgacctgcaaaggtatatgcaaaaagtagaagggcttcccaccaatttcctcacgttcgacaccacctataggttatggcaccttctgtacagcgttaaagacaaagtagagttcgaaaaagcgctcaaaaagttcgccaaaaagaaacaactagacaaaaccagcttcgtcgacagcttcaaaaacttcaaaccctaccccaacgaatacggctccttctccgagaaagcaatcaagaaactactacccctaatgcgcttcgggaaccactgggacttcaaccgaatagatgtatccacgcagaaacgcatagacgacctgataaacggagtcgccaacgaagacatccggaccattatccgcgagaaagccgaaaaataccagcttaattccgaaacctgcttccaggatctccccctctggctagcgcagtacgtagtctacaaccgtcacgctgaggccactgacatcgagaaatggaccagcgtttctgacctcgaagcctatctcgaagatttcaaacaacactccctgcgaaacccaatagtcgaacaagtcgtgacggagaccctccgcgttgtacgagatatatggcagcaatacggaggaggacaggccaacttcttcgatgaaatacacatagagctcggacgcgaactgaaaaagacggcagaagaacgtaaacaactatccgacaagaaccaggaaaatgaaaacaccaatctaaggataaagaaactcctagccgaactcaaagaggacgcctccatccaaaacgtccggccctactcccttgttcaacaagaattacttaaaatctatgaagagggcgtcttctccagcaccgatgaaatagaggaggacatccagaaaatacgcaagaaagtagagcccacaaccccagagatccaacgatacaagctctggcttgaacaaaagtacaagagtccatatacgggggaggtcatatccctaacaaaactgttcaccgaagaatacgaaatagaacacatcatcccacaatcaagatactacgacgacagcctctcaaacaaggtcatatgcgagtccgccgtaaacaaactaaaaacaaaccaactgggcctcgagttcatacaaaaccaccacggggaaaaggttcgaatcacggccaacaaggaagtgacaatattcacagaagaacaatacaaagagttcgtaaagaaacactacgcaaacaacagcgcaaaacagcaaaaactactcttaaacgaaatccccgagaaaatggtagcgcgacagctaaacgacactcggtacatctccaaatacatcagcgagatcctgtcaaaaatagtccgatcagatgagaaagacgagggggttaactccaaaaacatcataccctgcaccgggaaaatcacaaccgcactaaaacaggactggggcctcaatgacgtctggaatgagctgattctaccacgattcgaacgcatgaaccaactgacacaaacacagctattcacatcgtacaacgaccgactacagaaaaatctaccaacagtacccattgaatattcacaaggcttccaaaagaaacgcatcgaccatcgacaccacgcgatggacgccctcgtcatcgcctgcgccaccagagagcacataaactatatgaacaaccagcacgccctcgacaaatcaaaagacaagaaagaaaaacaacagtcacggatcgatctcagaaccatactgtgcgaaaagaaaaataataattggcaattcaagaaaccatggcgaaccttcacacaagaggctaaagaggcgctcgagcacatcgtcgtctctttcaaacaaaacctcagggttataaataaagccaccaattactacgaaaaatgggaagagaaaaacggtgtactcgtcaaaaagaaagtgaagcaggaaggcacaaactgggcaatacgcaaacccctacacgaggagaccttcagtggaaagataagcctaaaccgagagaaagtcggaaaggggaacatcttaacagccacacgcaaggcggtggacagctcattcgatgtgaaaaagatctccaaaataacagacaccggcatacagaaaattctactaaactacctcaaatacaagggatccccagaggtggcattctccgcagaagggctcgaggaactcaacaaaaacatcgcccagtacaacaacgggaaaaagcaccaacctatctacaaggtccggatctacgagaagggctctggacgcttcgtactaggggaaaaagggacaaagagcaagaaatacgtgcagggcgcgccaaacctttacttcggagtctaccaaggtaaagagaaaaggacgtacgccaccatcccacttaacgaagtaatcgaacgacagaaacaaggtctaccaagcgtaccggagagaaacgaaaaaggtgaacccctactattcagcctgtcgccaaacgacctggtctatgtcccaatggaaggagaggccactgaaacgattaacttcaacaacctgaacaaagaacagaaagaacgaatatacaagacggtgagcttcactggaaaccaatgcttctttgtccaagaagccgtagcatcacccatcgtcaacaaaatggagtattcaccactgaacaaaatggaacgcagcatcgtagggattatgatcaaggaagtctgcataaaattaaaagtcgacagactcggaaacataacaaaggcctga

SEQ ID NO: 6860 - RNA, 4362 nt, synthetic construct
  misc_feature 1..4362: note = Cas9 variant
  source 1..4362: mol_type = other RNA
atgaaaaccgtacttggcttagatctcggcacgaacagcatcgggtgggcactgatacagcacgacttcgattctaagaaaggcgaaatcttaggcatggggtcccgcataatcccaatgtcccaggacatcctgggagagttcggaaaaggtaactcagtcagccaaaccgcggaccggacaaaattccgaagcgcgcgcagactacgagaaagacacctactcaggcgagaacgactccacagagttcttaacatactcggcttcctaccacgacactatgcagcggacatagacttcgagaaacgcctcggccagttcttcgaagggaaggagcccaagctcgcttacgacaacaaccaattcatcttcaccaaatctttcgggaaaatgctcgcagactttcgtcaacaccagcccgatttcctcaaggacgagaaaagtaacgacctgctgataccctacgactggagcatctactacctccggaaagaagccctcacgaagaaaatcgaaaaagaagaactggcctggatcatcctgaactttaaccaaaaacgggggtactaccagctccgcggagaagaagaagaagagaacctcaacaaacttgtggagttccacagcctcaaaatcatcgacgtggtggccgacgaaaagctcaacaacaaaggagaaacatggtattcacttctactcgagaacggctggacataccgtcgatcatccaaggtgccactcttcgactggaaagagaaagtccgcgacttcatagttaccacagacatcaacgacgacggcagcgtcaaaacagacaaagaggggaacgaaaaacgctcattccgagccccctccgatgacgattggacgctgctcaaaaagaaaaccgagcaggatatcgacaagagtcggaaacccatcggcgcctatatttacgacgcaatcctgaaaaatccaaaacagaaaatcaacgggaagctagttcgcacagttgaaagaaaattctacaaagaggaactaaagctaattttacagaagcagaaagagttccaccccgaactccaatccaccgacctatacaacgaatgcatacgagagctctataaaaacaacgacgcacaccagctacaactcaacaagaaagacttcgtacacctattcttagaagacatcatattctaccaacgcccattgcgttcacagaaaagctcagtaggaaactgccccctagagttcagaaaatttaaagacagcgaaggaatcgagaaagtagagtacctcaaaactatccctaagtcaaatccatactttcaggagttccggatctggcaatggatgtacaacctgagtatatacaagaaggacgatgacgaaaacgtcacgagagacttcctaaaaacgatagaagactgggaagacctgttcgagttcctcaaccataggaaagacatagaacaagaaacgctactcaaattcctactaggcaaaaacggggtaaaagggaaggcactgaaagtagaggcaggaaaatttcggtggaactatgtctcagataaaatatacccatgcaacgaaaccaaagcactaatcatcagcaagctagagaaagtgaagggggtcgaggaaaagttcctgacagaggaaatcgaatacaagctctggcacctgatatactccgtgacagacaaggtcgaatacgagaaggcactaaaggcattcgccggtaagcaaaaacttgacctagtgagcttcgtagactccttcaagcggtttccgccattcaaaaacgaatacggggcctacagcgaaaaagctatcaagaaaatcttgcccctactcaggacggggaaatcctggaactggatggcaatagactcgaaagtccgtgaccgcattaacaaaatcatcaccggcgagttcgacgaagaaatcaaaaacaaagtccgagaaaaagcagaaaaacactccctcaagaaagaaaacgactttcaggggttgccactgtggctagcacaatacgtcgtctacgggagacactcagaggcgtcattctcgggaaaatggaactcagtcgacgaccttaaaaagtatctagaagagtttaagcaacactctctaagaaacccaatagtagaacaagtcctaacagaaacactgcgcgtagtggcggacatatggcaattctacggtaaaggagagaaagacttcttcagcgaaatccacatcgaactgggacgcgaaatgaagaacacggctgaggaccgaaaagagatgagcgcaatcatccaggcaaacgaaacaaccaatctccgaatcaaggcgctgctcaatgaactcctccaggacaagaaagttgagaacgtgcggccctacagcccctcccaacaagaaatactaaaaatatacgaggacggggtactctcctcagacattgagataccagacgacatccagaagatatccaaagcagcccaaccaaccaagagcgaactacagcgctacaagctatggctggaacagaagtacagatccccctacacgggagcgatgatccctcttggaaaactgttcacgagcgagtacgaaatagaacacatcataccacaatctctctacttcgacgactccttctccaacaaggtgatatgcgagtcagccgtcaacaagctaaaggactcacgactgggcatggagttcatcaaagaatgccacgggatggtcgtagaaacgggattcggcaaatcagtcacagtcttcgaggaagagacgtatagagatttcgtcgttcaaaactactccaagaaccacagcaagaaatcaaaactgctgctggaggagatacccgagaaaatgatagaacggcaaatgaacgataccagatacatctcaaaattcatatccagcgtgttaagcaacatcgtccgcgaagaagtaaacgacgacggagtcaacagcaagaacatagtgccagggaacggcaagatcaccactcaactgaagcaagactggggactaaacgacatctggaacgagctcatattgccacgcttcgaacgcctgaatgtactaaccgactcaaaacacttcaccgcatggagtgaaaaccatcagcgtctcctccccacggtacccatcgggctgtcaaaggggttctccaaaaagagaatcgatcaccgccaccacgcgctagacgctctagtcattgcctgtgcgagccgtaaccacatcaacttcctcaacaacgcgcacgctattgacaagaagaaaaattctgaagagaaacaaaaattccggcacgacctaaaggccattctgtgcgacaagaaatacagcgataaaagtgagaaaaactaccgctggatatttaagaaaccatgggacaactttaccatagactcaaagaacgcactagacaaaataatcgtctccttcaagcaaaaccttaggatcatcaataaggcgaccaaccgatacgaaaaatgggtcgaccgggacggaatcaaagtaaaagaatggcacaagcaagaagggatcaactgggccacccgcaagcccctacataaagatacggtgagcggaaaagtggacctgaagagagtaaccgtccccgaaggcaagatcctcacagcgacccggaaatccctggacacctcgtttgacctgaaggtaatagaatccataacagacactgggatacagaaaattctgaaaaactacctcacaagtaagtcgaacaacccagaactagcattcagcagtgaaggcgtggaagacatgaacaaaaacatacgcaagtataacgacggcaaactccaccagccaatatacaaagtccgcatattcgagctcggctccaagttccccctcggccaattcggcaacaaaaagttcaaatacgtggaaacggcgaaaggcactaacctcttcttcgccgtgtacgaggacgagaacaagaaccgcaactacgagacaataccactcaacgtcgttatcgagcggcagaaacaaggactcagcagcgtgccgataaaaagtgaaaaaggccacaagctgcttttctacctctcaccaaacgatatagtctacgtcccgggttcgaacgaagagttcagcatcgaccgcctataccggttcaccgactcctccgacaagacagccaacttcattcctctatccgtttcctccctgattttctcaagcaataagaacgaacaaaagaaaatcgggatctcctatccgatccaggacgagttcggccttggatcaccccaaagcaaaaaccaaaagtcaatcgacggaattatgatcaaggaaaaatgcgtcaaagtcaacatcgacaggctggggcgagtgtcattctga

SEQ ID NO: 6861 - RNA, 4368 nt, synthetic construct
  misc_feature 1..4368: note = Cas9 variant
  source 1..4368: mol_type = other RNA
atggctaaaatcctgggcctagacctaggaaccaactccatcggctgggcagtcgtggaagatcaaaacaacaaaaccacactcatcgacaaaggagtcagaatcttttcagaaggggtcaagatagaaaaagggatcgagaaatccaaagccgccgagcggaccgacttccggtccgcccgcaagataaagtttcgccgcagactaagaaagcaagaaaccctaaaagtcctaatagaaaataatatgtgcccactcacgattgaggaatggacaaaatggaagaaagacaagaaagaataccccaaaaatccagacttcataaactggctaaaaacggacgaactcaagaacatcaacccatactttttccgtgacaaggcctccaggaccgaactaccactcatgcaaacaggacgggccctgtaccacctggcgcaacgaagaggcttcctctccaaccgattagaccaaggctcggatggcttcacggagcaaatccgactggacctaatcaagaagatcgaatgcgagaccgataaaaccgaactgctgacgagcgtccaatcaatcatcgacacttacagtgaagaagaggacaaggacgctaagaaactcctgaaaggcgtcgaaaaactgtgcaaaataaacaacgagctaccaatcacagagttcaaggaaaagctgatcaactacctcaacaaagccgacaacctaggtgcagtcaagaaaggcatcgcagacgtcagtaagaaaataaccgaaacaggctgcgagaccctcggacaatacttctacaaactctaccaaaaccaaagtaaaatccgcaaagtttataccgcccgaacagagcactactaccacgaatttctcaaaatctgcgagacccaaaacatatgcgaccagctgaagcacaaactcgacaaggccatcttctaccaacgaccgctcaaatcccagaagggcctgatcggcaaatgcgtctttgaaaagaataagacccggtgcgcagtctcccaccccgcctatgaggagtaccgcgccctccaattcatcaacagcatcaaagtctcggaaaccaaggacggcaagaaagacttcctcagctttgacgagcgcaagaaaatctggcccaaattcatccggaaatccaaaccgaacttcgacttcaaagaaatcgccgaaacactcgacaaaaagggcctcagccgctattacaactatacaggccacacatcggtcagcggatgtccaacaatagcccagcttacaaacattttcggtgaaaactggcaagagacactgttcgagaaatacaccaacaagcaaaacaccaagggcctgaaaaccatcgacgaggtcgtgacagacatctggcatgtcctcttcaccttcgacaaagacgagaaaatcatagagttcggaaaacagaagctcggactgaacgaggtgctagccaagaaatttggtgccatcaacctaaagaaggactacgcctcactgtctctaaaggcaatcaataaaatcctcccatacctcagagaaggcctgatatattcatacgcagtcttcctcgccaacatcgaaaacgttgtaggggaagagatttggaagaacgacgagaacaaaaacctcataaagaaagaactccacctactcattgacaacttcaacgaaataaaaggactagaggcggtagtaaacgacttcattgccgacttcaaaaaggagtacaacaatgcacacaaagattacgttcttgacgaacaggacaagaaaatcctgctagagaaaatcgaatcaaactacggcaaaaacaaattcgagtcgctcgaacccgacaagaaaacggaaatcatcaatagcacagagaaaatggtcgccgaacaactgcggaagcaacggggagagttcatcaaacccaaacgactagacgagaaaataagcgagttcttaatcaataactttaacgtcacgaagaaaagcatcgcccggctttaccacccgagcgatgtagaaatcttcaaaacggctagccgcaacagcgaaggacttcttttactcggatcccccattgtctccagcatcaaaaacccgatggccatgcgcgcaatgcaccaactccggaaactcgtaaatacattaatcaaggaaaacattatcgacgaagagacaaagattaacatagaactcgctcgcgaactgaacgatgccaacaaacgagcggccataaagaaatggcaagacgaacgccaaaaagcccgcgaagaatacaagaagtcgatcaaagagttgttcaaagctgaatgtggcaaagacatcgaacccagcgactcagagatactaaaatacgaattatgggaggaacaacagcacatctgcatctacacaggaaaaacaatcaacatatgcgacttcatcggagccaacccgaacttcgacattgagcacaccatcccgaaatccctttgcttcgacaactccaatgaaaacctcacgctctgcgacattcaatacaatcgggacgtcaaacggaacaagatcccaaccgaactgtctgattacaacagcatcaaaccccgcctcgataagtggctcgtgttcatcgacgattacgaaaaactctacaacacacgaaagaaagctaaaggcatagaaacaaaagagcaaaaagacaaacgcatcaaagaaaagcactactacaaactccatctggactactggaaaggcaaatacaaacgctttataatggtcgacgttcccagtggattcaaaaactcacaaatagtcgacaccggcatcataacaaagtacgcgatctcctacatgaaatcgatattccccaaagtctattcagtcaagggaaacattgtcgccgagttccgaaaaatctggggcctgcaaaacgattacgaaaagaaagagcgcgtcaaccatgtccaccactgcatagatgcaatcacaatagcgtgcatgagcaaacagaaatacgataccctcgcaaaaatatatcacgaagacgaagcagggttccacaaaatcaagaaagaaacgcagctagtcagcaaaccctggacatcattcaccatggacgtgctgaacatagaaaaagaaatcttcgtatcacaccatacacccgataacatgaagaagcaatccaagaaagtcgttcgcgagcgtggcatcatagcaccgaaagtcatctacgagacagacgcgaacaacaataccctgagagacaaatacggaaagaaaatcgtcaaagaatacatcctattaaaagacgtcaacggcaacctaatcccaataaaaggaaaacgccttacgccgagtgacataataaataaagtggacgggatcgattacttctccctgatcataaacgacaagatccagtactacgagttcgccaaatcgaaaaagaccggaaaaattatatacaagaaagaaccaatctacctacagggcgataccgtaagaggctcacttcatctcgacacattctacggggcaatagcgaaagatataaacggtaacataataacaaatacaaacgggaaaattgcgcccaactacgtaatacggaaagaactctcgaaactgaaagaaaccgacatcgaaaatatcgtcgacccggtcgtaagaggaaaaatcatcgaagctaaaaagaacaagctcatcactttcaacaaatccggcgcagtcataaagaccaccatctggatgaaggaaaaccaaatacccatcaacaaggtacgcgtttatagcagtctcaagaaccccctcccagacttcaagaaacacagagacctgtcccacctcacatacaaacaacagtacaatgtctccaacgaagaaaactactgtctcgcaatttacgagggcaaaaacaagaaaggcaacgtatgccggacctgcgagttagtaaatatgatagacgcaggcaactactacaggctctccaacaagaactggaaacaacaataccccattgtcccagaaaaagacagcgtcaccaactacagcttgaaaactataatcaccaagggactcatggtgttactatacgaaaagagtcccgaagaaatctgggaactcacgtacaaccaacaaatggaacgactctacgaaatcacgcaactggacactgagaaaagcgcggaaataaaactactattccaccaggaagccagggaaaagaaagttatcaccgaatacatgggactcaagacagggatgaaagggggaaagaatatcggaaaacacaaagagttcccctggatcaaagtagggccaaacagtttcgacgccctcatcgaaggcatagatttcaagctaacgcccaccggcaaaatcataaagctgtga

SEQ ID NO: 6862 - RNA, 4374 nt, synthetic construct
  misc_feature 1..4374: note = Cas9 variant
  source 1..4374: mol_type = other RNA
atgaaaaccatcctgggactcgacttgggtacaaatagcataggctgggcaaaggtatctgtcgacgactacggcaattacctgcacgacatcaagctagggtcgcgcatcataccaatgagtcaggatgtactcggaaacttcgactcaggagtaacggtcagccagacagcacaacgaaccgagttcagaagcaagaggcgactggtccagaggaacctccagcggagggagcgattgcacagggttttacacgtactcgattttctccccgcccactacgacgcggccatcgggtgggatcggaccgaagccgtcacgtacggaaagttcctgaatcacgcagagccgaagctggcatgggaggagctcggcaacgggaaacgacgatttctattcatggacagcttccacgaaatggtcgcagacttcgcacgatgccaacccgccctggtcgcagacggcaagaaaataccgctagactggaccatatactacctaagaaagaaagcactcacacaagccataactaaagaggagctagcctggatcttactcaacttcaaccagaaacgcgggtactaccaactcaggggagaagaagaggaagaaaatcccaccaaacaagaagagtactacgagctcaaagtcgtgtccgtagaagccacggatagcagaaaaggcaatgacacctggtacaatgttcatctcgaaaatgggtggatctaccggcgatccagcaagatcagcctagacgactgggtcgggaaagtgaaacagttcatagtcaccacagagtacgaaaaagacggggctaccctcaagaccgataaagaaggctacgtaaagcgctcgttcagagcaccaaacgaaaatgactgggggctgcgaaagaaacgaactgaaaccctcctcgagatgagcggaaaaaccgtaggagccttcatttacgaccatctgctccaagaaccggcagacaaaatccggggcaatttcatccggacaatcgagcggcactactacaaagccgaactcgaagccatcctcgccgaacaatgcaaataccacatcgaactgcgggacaaagaaatgctagaggcgtgcgcgcgagaactgtaccttaataatctaccacaccaaagatcactgatgaagaaagacatgacatacctgctcctctacgacctgatcttttaccagagaccgttaaaatccaagaaagcgctcatcgctaactgcccgtacgaatattacgaatacgtagacaaagaaacaggagagataaaaagacagaacatcaaatgcatagccaaatccaacccatacttccaggagttcaggctatggcagttcgtcctgaacctacgacttttcgatcgtgtcgaagacaaggaagtcacggcaaactatctaccgaccgccgacgaccacgcacgcctgttcacgtacctaaacgaccggaaagagataaaccaggaaacgctactgaaagattatttcaaactcaagaaagtaaaaatcggcaatgagaaggagtatccgatacgatggaactatattgaagacaaggaaaagaaatacccatgtaacgaaacccggtatgagctcctcatggcactcgaccgagccgggatagaacacaaatggctcgacgacaacaacctcgagtatcgactgtggcatctgctctacagcgttgaagtaaagagcgaaagcgaaaccgcattgcgcaaactcaaaaacgacgacgccttcgtgaacagcttcttaaaagtgaaacctttcaagaaagaatacggcgcgtatagtgaaaaagccataaaacgtctactggctgtcatgcgcaagggattcctgtggaacgaacaggacatttgcgacgaaacgcggaagagaatagaaataattatcaaaggagacgtagatgaaaaagtaaaagagcgaatgggacacgccgcctacagcttcgaccgcgtatccgacttccagggattacccgaatggctcgcctgctatgtcgtatacggacgccactccgaggcaatggacatacagcactgggactcaccagaaagacttatggcctacatcaacaacttcaagcaatacagcttgcggaaccccatcgttgaacaatgcatcctcgagaccttgagaacggtccacgacatctggaaggaaaccgggcagatcgatgaaatccacgtcgaactgggtcgggaaatgaaatcgaccagcgaagagagagcaagacgaacccaaaacgtcctacgcaacgagaacaccaacctgcgcataaaaagcctcctaatcgaactcaaaaacgacaccgacatctgcaatgtgcacccatactcaccgatgcaacaggaaatcctccgaatatacgaagaaggcgccttacaagagctaaacagagaagacgaggacttcgaagaaatcagcaaaatatcacaaatgtcacaaccctcagggaaagagctgaaccgatacaagctatggctagaacagaaataccggagcccatacaccggaaaagccatcagtctggccaaactatttacaccagcgtaccaaatcgaacacgttatcccacaatcgaggtacttcgacgacagtttcaccaacaaggtaatatgcgaagcggaagtcaacacgttaaagtctaacctactcgggtacgagttcattaagaaacacggaggggaaatcatacactgcacaacccttggagacgtacggatcttctccgaatccgaatacaaagccttcgtcatggaccactatgccaacaacaaatccaaaaaggacaaattgctcatggaggacatcccacaagagtttctatcacgacaaatgaacgactccaggtacatcagcaaagttgtcaagaccctcctttcgaacatagtaagaatggcggacgaatccgaagccacatctaaaagcgtgatcgtatgtaccggaggcgtgacggaccgacttaagaaagactggggactgaacgacgtatggaacagcatcgtctactcccgcttcgagcgactcaaccggctaaccggaacagaggccttcgggcactgggaaaataaagacggcaaacgcgttttccaaacctccatgccactagaactccaacgcggatttcgaaagaaaagaatagaccaccggcaccacgccatggacgcgctagtcatagcatgcgcctcgcgaaacatcgtaaactacctcaacaacgaatcggcaaataaccccaagaaaagagaagacctgcgcaggcaactctgcgacaaaaatcgagtcatccgcaaaccgtgggaaacgttcactcaggacgcgtacaacgcgctggaaaacgtagtagttagcttcaaaaactacgtgcgcgtaataaacaaagcaacgaaccgctacgaacactacgacgaaaacggaaagaaacggttcgtacaacaaaagggctccgaattatgggcgatacggaaaccaatgcacaaagaaacctactacggccacgtcaacctacgacgaaaagagctcgtcaccctccaaaaggccctcgacgacataccgtcaatatgcgataagaagctacgggattacatcagcgcactcgtagaaaaacacttcaataagcgacagctactagcccatttcaaatccacagattactactggcaaaagcaatacgtaaacaaggtctacgtctggaccttctccgacgacataaagcccctagtagcaacgcgcaagctgctcgacacctcattcgatgcgaaaaggataggaacgattacggacactggcattcagaaaatactccgcaactatctcgaggccaaaggcggaaacgctaccctggcgttcacaccagaaggaatcgccgagatgaaccaaaacatatccaaatacaatgacggcaaaccacaccaacccatactcaaggtccgcataacggagcccatgggcgctaaataccgagtcggacaaacaggaaacaagatggccaagtacgttgaagcccagtccggcaccaacctttacttcgccatttacgaagactccgaagggaaaaggagctacaccactgtccccctagacgaagtggccgagagactaaaacaacgactatcaccagtacccgagaaagacgaaaacgacgtccccctcaaattctacctaagcccaaacgacctcgtctacgtccccactgaggaagaactgcaacttcgagaatgcaaactaaacaaagaccgaatatacaagatggtctcaagcaccggcaatgaatgccactttataccctactacgtagcgaacgtaatctacaacaagggcgggttcaatatgcagatgcaccgcccccagtcctga

SEQ ID NO: 6863 - RNA, 4374 nt, synthetic construct
  misc_feature 1..4374: note = Cas9 variant
  source 1..4374: mol_type = other RNA
atggccaaaatcctcgggctggacctcggtacaaacagcattggctgggcaatagtcgagaagaacaattcagacttcacacttatcgacaaaggagtccgcatcttctccgagggagtcaaaacagagaaaggcatcgaacggtccagagcagcagaacgaacagggtaccgctcagcaagaaagatcaaataccgccggaaactccgaaaatacgagacgctgaaagtcctctccaagaaccggatgtgtccgctacaaatcgaggacgtcgaggcttggaagaagtcggggttcaaagattatccactcatccccgagttcctccaatggttacgcaccaacgaccacgaaaacgtaaatccctacttctttcgcgataaagcatcaagagccaaggtgtccttatgggaactggggcgggcgttctaccacatcgcacaaagacggggcttcctgtccaaccgcttagatcagtcaagcgaaggcgttctagaagaacacaacccccaaatacaatccctgatcgaagacctagaagaaacaagcacaatcctcaacgaagtgagagactactacatcaatctcggcctgctcgacggcgtgaaaggggacttcaagaaagaactcgacgagggcgagaagaaactgaaaagcctctacaacacactaatcgcgatcatcaagaaaaacgagaacgacgtccagaaatgtaaagacgaaattataaaaagactcaacaaaaaggaggacctagggaaggttaaagggaagatcaaagacatcagccaggcaatgctagacggaaacttcaagacgctggggcaatacttctactccctttacaacaagggcaagatcagaaaccagtacaccagccgcgaggagcactacctccaggagttcataaccatatgcaaggtgcaaggcataaacgggataaacgacgaagaaatcttgccggaaaagaaattcaccggcctggccaaagacctgtacaaagcgatcttctttcagcgacccctcaaaagccaaaagggcctgatcggaaagtgtagcttcgaaaagaacaaatcaaggtgtgccatctcacaccccgacttcgaagaatacaggatgtggaactaccttaacaccataaaattcggcacgcaaagcgataagaagctcagatttttgacccaagaagaaaaactcaagctaatcccaaaattctaccgcaagaacgacttcaacttcgaagtgctcgccaaagaactcatagacaaaggagcgacctttggcttttataaaagcagccggaaaaacgagttcctatattggttcaactacaaacccacggacaccgtctcagcatgccaattcagcgcgtccctaaagaacgcaatcggagaggattggcagacgaaagtattcacctacaagacactgaactcggaaaagaaggaagtaataagaacagtcgactaccgagatttgtggcacctactctcagcctcgacttccgacatttacctctacgaatacgcgaaagagaaactgggactcgaggacaaatctgcaaaaaccttctcaaaaatcaagctcaagaaagactttgcctcgctcagtctcagcgcgatcaataagatactgccatacatcaaagaaggactgctgtacagtcacgcggttttcatggcgaacatagaaaaggtagtggacgaacacatttggaaggacgtaaaagaacgaacgataatacaaaacgaaatctcaaaaatcataaaatcggacgtgttcgaacgcgaggtaatcaacatcataaacggcctaatcaagaacagcaaaacggagggggaaaactacgcggaggaaagtaaaaacattttcaagacggagttcgacaatgccatcgccaagatcttcgaaaagaacaatgatatcgaatttaaccaacccttcctggacgacacctacctcaaatacgtcgaggaactcaagaaattcgataaagcgcgtagcttcctccccgtcccgcgacttgacgaaaaagtaatacaattcctactgggaaacaacaaggacggaatggtatattgcagtgacaaaaacaagaccaagaaactgtaccacccctcagacatagaaatattcaagaagaaaatcatcaaagacgagttcggtaatgagaaaatggtcctggggagtcccctcacaaccagcattaagaacccaatggcgatgcgcgccctccaccagctccgaaaagtactcaacactctgatcctcgaggaacaaatagacgaaaacacacgcatccacatagaaatggcccgcgaattaaacgatgccaacaagagaaaaggcattcaggattaccaaaatgaaaacaagaaattccgggaagacgcaatcaaggaaatcaagaaactatacttcgaagagtgcaagaaggaagtcgaacccacagaagaagacgtcctgaggtaccaactatggatcgagcaggacaagaaagagatatatgagcaaggaaaatcaatccgaatatcggacataataggttcgaacccggcatacgacatagagcacacggtcccgcgcagcatatcccaaaacaactcccttatgaacaagaccctctgcaccccgcgcttcaatagagagatcaagaaacagaaaatgccgatagaactaagcaactacgaagaaatcctcccacgcatagaacactggaagaaagaagccgaagacctcacgaggcagatcgagtcaatcagcaaatcaatcaaatcagcctcaactaaagaagcaaaggataaaaacatccgtcgccgacactacctaaccctcaagcgcgactacctaaaggggaagtacgaccgattcatatgggaagaacctaaggtgggtttcaaaaactcccagataccggacactggaatcataacaaagtacgcccaagcgtacctaaaatcctacttcaaacgggtcgagagcgtcaaaggcggtatggtagccgagttcagaaaacagtggggaatccaggaaagctacatagacgaaaacggatttaaacactacaaggagaaagaccggagcaagcacacgcaccacacaatcgacgcgattacgatcgcatgcatgacaaaggacaagtacgacgtactagctcaggcttggaccagtgaagatgaacaggacaaacaaaaagcgaaaactctgatgagcgaggctaaaccatggaagaccttcaaggaagatatagagaaaatagaggaagagatactcgtgagccacttcacactcgataacgtcaagaaacaatccaagaaaatagtccgagtacgtggcaaaaagcagtacgtggccgagatcgaacgagacgtcaatggcaaagccatggcaaagaaggatgcgaacgggaaaatcatctacaaactaaacgaaaagggcgagaaaatcccgagactccaacagggagacacaatccgaggcagcttacaccaggactccatctacggagccatcaagaacccccttaaccaggaagagatcaaatacgtcatcagaaaagacctcgagagcctgaaggctaatgacgtggataacatcgtagacgaaaccgtaaaacaaaaggttaaagaagcaatagaaaataagatcctacttctatcctctaacgcccagcaaaagaacaagctcgtggacgacgtctggcttaacaaagaaaaacaagtaccaatcaagaaagtgcgtatatacgcgaactccgtaaagaacccgctggaaatcaaagagcagtccctcctcagcaaaagccgcaaagagcacaaacaaaaggtttacgggcaaaacgacgagaactacgctatggccatctacgaattagacggcaagcgagagtttgagctaattaacaacttcaacctagccaaattgataaagcagaaagaaggcttctaccccctgaacaaggaaaaagaagtaaagggcaaaaaggttctctatcccatcgcaaagtcgaactaccgcgacgtagtcctgaaacgcggacaacaggtggtattctacgacaaagaggtagaaaaccccaaagacatctcagaggtcatagacttcaagggacgaatatatatcatcgaagggctcagcattcagcgaatagtacgcccgtccggaaagatagatgaatacggtgtgattatgctcaagtacttcaaggaggcccgaaaagcagatgagatcaaaaaggacaactacaagccagacggcgtgttcaagctcggcgaaaacagaccaacccgtaaaatgaatcacagccaatttaccgccttcgtcgaggggatcgacttcaaagtgctaccgacgggaaagttcgacaagatctga

SEQ ID NO: 6864 - RNA, 4377 nt, synthetic construct
  misc_feature 1..4377: note = Cas9 variant
  source 1..4377: mol_type = other RNA
atgacaaagacaatactaggcctggacctcggaaccaactcaatagggtgggcactaatcaaccaagacttcgacaacaaaaagggtgaaatactcggaatgggctctcgcatcatccccatgacgcaggacatcaaagatgaatttggcaagggaaactccatctcccagacagccgaacgaacacgccttcgcggcgtcaggcgcctaatccatcgaaccctcctgcgccgggaacgactccacagagtgctcaatatcattggcttcctccccgaacactacgcaaaccaaatcgacttcgagaaacggttcggaaaattcaaaccggaaagcgaaccaaaaatcagcttcgacggaaacgacgtgttcctatttgaaaagagctaccaagagatgctggtagactttaagatacaccaaccccaattagtctcgaacggcaaaaagataccccacgactggaccatatactacctacgcaagaaagccctcagcaagaaaatagaaaaagaggaactcgcgtggatcctgctaaacttcaatcagaaaagaggttactaccagctacggggagaggaagaagaagagacgcctaacaaactcgtggagttccactcattgaaaattgtagaagtaaatgccgatgaaccacaaaaaggaaagcctgaaatctggtacagcctcgtacttgagaacggatgggtttacagacgagcctcaaagacgccactgttcgactggaaagacaagatcagagagtttatcgtaaccaccgagatcaacaacgacggaaccgtaaaaacagacaaagaaggcacagagaagagatccttccgggcgccaaaacccgaagactggacactccaaaagaagaaaacagagttcgagctcagcaaatccgggaacgaagtcggcgctttcatatacgagagcatccttcaaaaacctaaccagaaaataagaggaaaactcatctccacgatagaacgaaaattttataaagaagaactcaagacgatcctaaagacccaacttttcttccataaggaactcaaggacgaaaagctctacaacgcatgcatcgaagaactgtacaaaaacaacgaagcccaccggtccctgttaagtaacaaagggttcgagcacctattcataaacgatatactattctaccaacgccccctccggagcaagaaatcccagatatcgaactgccccctcgagaaaagaacatacaagaaagaaggaattgaaatcacggaaggcataaaggtcatctccaaatcaaacccgatataccaagaatttaggctttggcagtggatctcgaatctgagcttgtactgcatcgagccgacagagaccaacgttacctcaacattcctcaactccatcgaggactacgagaacctattcgagttcctcaataaccgaaaagaaatagaacaaaagcacctactaaagtatctactcgaaaaccaggggttcaaaggaaagctgctcaccaacgaactcgaaaaattccgatggaacttcgtagctgacaagaaatacccatgtaatgagacaggctccctactacacaccagactctccaaagttaaaaacataagccccgatttcctcaccaaagagatcgaacaccagctatggcacattatctactccgtaactgataaaatcgaatacgaacaagccctaaagaccttcgcccgcaaaaacaacctggacgtagactcgttcttcgagcacttcaagaaaatcccgcccttcgagtccacatacggagcatactcagagaaggcgatcaaaaagctcctaccactaatcagactcggcaagtactggaattgggaggctattgactccatctccaaagacagaatctcgaaaatcctcagtggcgaatacgatgaaaacatcaaaaatcgtgtgcgggagaaagccgtccatctcactagcgagaacaacttccaaggtctccaggaatggctagccaagtacatcgtctacgacagacatagcgaaggcaacgatctcggaaaatggaccagtgtgtcagacctagaaacatacctgaaagagttcaaacagcactccctgagaaacccaatcgtagaacaagtaataacagaaaccctccgtgttgtcaaggacatctggatcaagcatgggaaggggacagaaaacttcttcgacgagatccatgtagagctcggccgagaaatgaaaaacaacagcgaggaccgaaaacgcctcaccaacaccatcaccgaaaacgagaacactaacctacgcatcaaggcactgcttatggaaatgatgaacgataatgacgttgagaacgttcgaccctactcaccctcgcagcaggaaatacttaaaatctatgaagacggagccctcaactccaatatcgaactagacgacgaaatcgtcaaaatctccaagaaagcagagccaactaaatcagagctgcagcgatacaaactatggttagagcaaaaatatcgttccccctacacaggacaagtcatccccctcaacaaactgttcacatcagagtatgaaatagagcacgtcgttccacaatcaagattcttcgacgactccttcagcaacaaagttatatgcgaatcagcagtaaataagcgcaaagacaaccagctaggccttcaattcattaaaaaccactccggcgaaaaagttgaacttggcttcggaaaagtagtccaagtattcacagaggagcaatacctggactttgtcaaagaacactactccaagaaccggagcaagcacaacaaactacttctggaggaaatccccgaaaagatgatcgagcgacaactcaacgacacgcggtacatatccaagttcgtaagctccattctcagcaacatagtacgcagcgagaaagacgacgacggactaaactccaaaaatattctcccagggaacgggaaaatcaccacggaactcaaacgcgactggggccttaatgacgtctggaacgacctaatcctcccccgattcgaacggatgaataccataaccaattcggatctcttcacaacctacaacgacaaataccaaaaacacctacccacggtcccattcgagtactccaagggcttccaaaagaaacgaatagatcaccgtcaccacgcgatggacgcacttgtcatagcctgcgccacccgtgaccacctaaacctaatgaacaaccagtccgctaaatccgagctcaaacgatacgaccttcaaaacaagctacgcaagaaagagccgtacttcaatcaaaaagagaataaacagaaagaggccttcaaggacttcattaagccgtggggcactttcactgaggattccaaaaacgcgttagagaagattatcatcagcttcaaacagaacctccgcgtgataaacaaagccactaactcttacgaatcctacaaagacgaagacggcaacctgcgtataggaaaagacggaaaaccagagaaaggactcatcaagcaaaagggactcaactgggccattcgcaagcccttacataaggacaccgtaagcggacaaatcaacctaagtcgaatcaaattaccgaatggcaagatcctaacagcgacacgtaaaaacctcgacaccagcttcgacttaaaaacaattgagaactccatcaccgacactggcatacagaaaatactgaaaaactacctactatcgaaagaaagccccgagctagcattcagccctgaaggcctcgaggaaatgaacaacgagatagagaaatacaacaacggcaaattccatcacccaataaacaaagcacgaatctacgagctcggctccaaattcaatgtcgggcaaacgggcaatagacgtgataaattcgtcgaagctgccaagggcacgaacctcttctttgcaatctatcaagacgagaacaagaaccgttcgtacgaaacaatcccacttaatgaggtcatagagcaccaaaaatggagggcctcgctaccaaaagaggaacaagagaagattccacttgtaccggtgaacaagctcaaagggacgttcatattctccttatccccgaacgacctggtttacgtaccaagcaacgacgaattagaaagatccgccagcatcgacttcagcaaactcaaaaaggaacagataaacagactctacaaaatggtctcaagctccggctctcaatgcttcttcgtgaaatccgaggtagccacttcggtcgtcaataaaatggagtactcgagtctaaacaaaatggagaaatccatcgacaacctcatggttaaagaaatctgcattaaactaaaaatcgatcggctcggaaacatctccaaagcgtga

SEQ ID NO: 6865 - RNA, 4377 nt, synthetic construct
  misc_feature 1..4377: note = Cas9 variant
  source 1..4377: mol_type = other RNA
atgaagaaaatcctcgggttggacttaggcaccaacagcataggttgggccctaatcgaacaagacttcgaaagtaaagcaggcaaaatttcaggcgccggatcgcgaataatcccgatgagtcaggacatcctcggcacatttgaaaccggccagagctactctcagacagcagaccgcacccactaccgctccatacgccgcctttaccagcgcaccaaactccggagggaacgactccaccgatcactaaatgtgctcggcttcctccccgaacactacaaaaacgaaatcgatttcgagcaaaggaaaggacaattctaccccaacaaagaacctaaaatagcctactatccggaacaggtcgcgtccaaagtaaagtaccaatttctgtttaagagctcattcctggaaatggtagaagacttcaagcggcgcggctacaacggcgcaattccgtacgactggacgatatattacctacggaaaaaggccctcgaaaagaaaattgagaaagaggaactggcctggcttctgctgaacttcaaccaaaaacgaggatactaccaactccggggcgaggaagaagatacaaatagcaacaagaaagaggagttctacgaactcaaagtcagctcggtcgagcaaacacacgatacctccccgagcggaacatggtacaacgtccacctccaaaacggctgggtttatcgccgaaaaagcaaagactccctaaaagactgggaggggctaaacaaaaagttcattgtcactacgcacctcaacgcggacggatccgaaaaactggataaagacggcaacgtatcccgctctttcagagcccccaaagaggacgactgggggctggttaaaaagcgtacagaaagcgtactcgaaaagagcgggctacacgttggagagttcatatacgaatccctcctcgaaaatcccgagcagaagatacgcgggtccttgatcaaaacgatcgaacgcaaatactacaaaaaggaactagaagcgatcctagacaaacaaacgtctttccaccgcgagcttaggaacgacgccctctacaaggaggctacattagagctttacccgaaaaactccgcacaccgcagcaacatcaaacagcgcgggttcaaataccttttcatagaagacataatcttttaccaacgcccgctcaaatcccaaaaacacctcatcgcacactgtcagtacgaaaaacgcacatacaaaaacaacggaggcgaaacgatcgaggtgagcctccagggggcccccaagagtcacccgagcttccaagaatttagaatctggcaattcatctcaaatctaagattctacgacaaggaagaaatcgtggagggacaggaggtaagcataacggaaaaactcctcaagagcgactccgacttcgccgaactctaccactggctatcccaccagcgagaagtggaccagaacaaaacactcaaatatttcacacaaaagaaacttattcccaaacagaagaaagacaaccccaccatcagatggaactttccagaagacaagaaatatgaaatgggcgagttcaaagcacaactcctcagccgactagaaaaagtccgaaactgccagcccgacaaattcctcacccagaaaaacgaactagacctgtggcatataatctattcagtgacagacaaaaccgagttcgaaaaagccctcgtcacttttgccgaaaagcgagaactggactccgaatcgttcgtcgaaaacttcaagaagttcccgccattcaagaacgattatgcgagctattccctaaaagcaataaagaagatcctccccctaatgaggaggggcaaatactggaaagcagaaaatctcggtccccaaacattacaacgtatcgagaagatcgtcaacggcgaagccgacgacaaaataagcatacgcgcccgcaaactcgcactgcacctaaacgacaccaagagctttcaagggcttccaacttccctcgcatgctatgtcgcctacaaccgacacagcgagaacgaagaaaatcaaaagtggcagacgcccagcgatatcgacaaatacctgaaagacttcaaacagcactccctccggaaccccatcgtggaacaactcataaccgaagcactacgtgtggttcgagacatatggaagcactacggacaaggtcagaaggacttctttgacgaaattcatgtagaactaggacgggaaatgaagaatcccgcaataaaacgcaagaaactaagccagaaaatacaagaaaatgagaacacgaactaccgcataaaagaagtactcagaaatctaaaagagaacaacatcgacgccaaaccctacagcccgtcacaccaagaaatactcaaaatctatgaggaaggggtatatcaatcaatcgaaaacgtcgaagacgaaatagagaagatccgcaagaataacactccgagctccaaagacataaaccgataccgcctatggctagaacaaggatacatctccccctacaccggagaagtaatacccctcagccaactatttagcaatcaatacgaaattgaacacatcatcccccgctcccggtttttcgacgattccttggcaaacaaagtcatttgcgaatccagcgtcaacgctcttaaggacaacaaaacagccctcgagtttatcaccaaccatggcaacgagaaagtcgagttcgccggaaaaacagtagaaatcttatcatccgacaagtacacagaacactgcaagcggtacttcaaaaggaaccgtaccaaactgaaaaatctgctgtcttatgacgtcccagaggggttcataaaccggcaacttaatgactcgcgcttcatttccaagtatgtccgaaacctcctcagcaacatagtccgtgaagaagaggaacgcgaagcaatatcaaagcacatcctgacgatcccaggttcgataaccagccagctgaaacaagactggggacttaacgaaaagtggaacgaagtcgtcacccaccgcttcgagcgtctaaacaacctaactggaaccacggacttcgggttctgggacaacaaaataaacgcattccgaataacagtgcccaaggaactaagcaaaggattcaacaagaaaaggatcgaccacaggcatcacacacttgacgcacttgtaatagccgcctgtacaaaagaccacgtcaattacatcacctcccttaacaccgagcgaaacaatcactccctcgtatcaaaactaagaaatacaaagaaagtcctcatcaacggcaaagagagacgaatagcaaaggcttacaaactcccctggtccagcttcccgcttgatgcaaaacaccaactcgaaaccacagttatatccttcaaacaaaatcttcgcgtcataaacaaatcttcgaacaaaacctggcaatggagaaacgtcaacggagaacagaaaaagaaactaataccacaaacaaaaggcgattcatgggccatacgcaaaagcatgcacaaagcaacagtaagcgccaaagtagaaagcgtaggcaagggcaaaataaagacgacaaaccgaacgcccctcggagagatcaaaggagaaaaacacgtcgagaaaatctacgacgcacgcattcgagaagtcatcatcccgaaccacctaaacaagtacctcgacgagaagggaaaacccaattacgaggcagcattctcccaatccggcatcaaacagctaaacgaaaacatcgaagtcctgaacgaaggaaaaccacatgccccaatctataaggtcccactcttcgaagtaggaagcaaatttcctgtttcagaagacgcaaagagccccaagaaccagaaatatgtcgaggcagacaaaggcaccaaccttttcttcgcagtatactggaacgaagagaaacaaaagcggaactttgaaaccgtaccactccaccaggtcatcgtccaccaaaaacaagtagcctcactacccacggaacaacggacctccgtgccgatcaaacccgaactaggcctctttctgttttccctaagccccaacgacctcgtatacgtaccaacagaagaggaaatcgagaacccacacctggtcgacctcaaaaatctaagcaaggaccaaaccaaccgcatatacaagatggtgtcaagcaccggcaacgaatgccattttatcccccaccacatatcccgactaatcatgaagtacaacgccaaacagaaagtcggggaatttggatccctcaacaaggccgagaaggccatcaccggcgagaccatcaaagaaaaatgcctcaaaatccaaataaacagcctgggaaaactcaagaccgagagaatagcatga

SEQ ID NO: 6866 - RNA, 4380 nt, synthetic construct
  misc_feature 1..4380: note = Cas9 variant
  source 1..4380: mol_type = other RNA
atgaaatttaatctaggcctcgacatcggcacaaactcgataggatgggccctcgttaacgaagactacgagaacaagaagggcaaaatcatcgcggccggcagcagaatcatccccatgacacaagacatcctcgacaagtttggcagtggcgccatcacggagacccaaacagcactcagaaccgattaccgcagcaaacggaagctaatacagcgcttcctgctccgccgcgagcgcctacacagagtccttaacgtactggactttttaccaaaacactacgcggagtcgatcgacttcgagaaatacttcggcaagtttctacccaacacagagcccaaattagcatacaaccaaaaccaattcatcttccaaaacagcttcctggaaatgctcaaagaatttcaagaaaaacacccagaactgctcacgaacaataagaaaatcccctatgactggacaatatactacctgcgtaagaaagccctcaatcaacggatcgaaaaagaggagctagcatggctgctcctacaattcaaccagaagcgcggatacaaccaactacgggacgaagaagaagagagcgtcccgaacaaacaggtcgagttctactccttaaaaatcatcgacgtggttgcggaccaacccaaagagggacgtgacaagcgctggtacagtatcaacctagaaaacgggtggacgtaccgaagagaatccaagacgcccctattcaattgggagggcaaaaccaaggacttcatcgtgaccacggacctcaaccaggacggatccataaagaaggataaagagggtaaagaaaagcgctcattccgtgctccctccgagggcgactggactctgctcaagaagaaaaccgagaaagagatatacgaatcaggcaaaacgctcggtacctacatatacgatgcccttctcaacacccccgacctcaaaatcaaaggggacttcattagaacaatagaccgctctatttacaaggaggaactccaacaaatcataaacaaacaaaaagaataccacctcgaattaaactcctcaaaactatacaaagcgtgcctagaggagctgtaccccaagaacgagatctacaagtcggcacttaaaaataaagacatagcataccttttcataaatgacatcttatactaccaacgcccactaaaggcccccaagtacaacataggaaaatgcacatacgaatcgcggacctttaagaaagaagacaagaaaatccgcgaatacattcccgcagttgcaaaatcccacccactctttcaagagttccgtctctggcagtggatcaaaaatctaaaaatatacgaaaaactttcaagcgataactgcaccgatttctttctgacgaatgaacaggacttcgaaaatctattcgagttcctatggaacaagaaagaaatcgaccacaaaggaatcctcgaataccttgtcaaaaccaagttccctgacctcaaaccaaaacaggtaaaaaccaaagtaaaagaataccgttggaactacgtatacgaccacgagaaagacgaaagcaaaacctacccctgcggtgaaacctacttcctactcaaaaacaaactcgataagatctacaatgcccaggacgacttcctggacaaggaaaggctctacaacctctggcacatcatatactccgtgacagacaagaaacagtacgagaaagcactagcgaaatttgccctcaaaaaccacctagacacaaagagcttcgttaacacattcaagcgaataccaccatttaaaaatgactacgccatctacagcctcaaggcgattaagaaactccttccgctcatgcgcgtaggcaaatactggaactacgacgacatcgaccccatcaccaaacagaaaatacaatgcatcatcaccggtgaggagaacgacaccatcagcaccctcgtgcgtgagaaaactaaccacttcagcaatgaaaacgacttcaaaaacctccccctgtggctcgcaggctacattgtctacaactcgcacaacgagtcctcggagatagagaagtggaaatcaccccaggacatcgacaccttcctcaagaaatttaaacaacacgcgctcagaaatcccatcgtggaacaagtggtgacagagactctacgagtcgtgcgcgacatctggtccaagaaaggacaaggcaaaaaggacttcttcaacgaaatccacatagaactcggcaaagacctgaagaaccccgtagataaacgccgaaaactgtcctcgacaaacacgaagaacgagtccacaaacacccgcatcaaagccctcctcattgaacttttcacacaaggagtcgagaacgtaaaaccaaactccccgaaacaccaggagatcctaaaaatattcgaagaaggggccctaaacagcggtatagaaatcgaagaggacataataaaaataagcaacaccgaccaaccaaccaagaaacaactcgagctatatatactctggctcgaacacaaatacaaatctccctacaccgggcaatcaatccccctctcaaagctattcacccccaactacgagatagagcacatcatccctagatccaaatactatgacgacaatttgtccaacaaggtcatctgcgagactgagataaacagattaaagaacaaccagctcggttatgagttcatcaacaaccacgaaatccgcgaagtaaccctagaggagggcaaaaccatccgtctcctatcacccgaacagtactggaacttcgtcacgacctactacgcaaagaataaagcaaaacgggaaaaccttctcctgaaggagctccccgtccagatggttgaaaagcaactaaacgacacccgctacgtctccaaatatgttatgcagctgctcagcaaaattgtccgcaaagaagacggcacggacaatggcatcaacagcaccaacatattgtccatctcaggcaaaatgacacgggccctcaagaacgactgggacctcaacgacgtctggaatgacttactgctctaccgttttgagcgcttgaacacgataacaaagaccaacctcttcaccacctacagcgaacaaaagcagaagcggatgccgatcgtcccggaccagtacgccaaaggattccacaagaaacgcctagaccatcgccaccacgccctagacgccatagttatcgcgtgcataaccagaaaccacatcaactacatgaacaaccaaaacatccaaggcgaaaaactcaagaaaaacgcaatcgaaaaagaaaactaccgagagatcctgcaaaaatccaggcttgacatcagagcacagctctgcgaaaagaaatacaacgacaacgatccgaccaaatacaactgggtattcataaagccttgggcggactttacagagaacacaaaggacatactcgagtccataatccccagctttaagcaaaacctacgcataatcaacaaaacagtcaactactacgagaaatacaatgagaacgggaagaaagtcaaagtccgccaaataaaaggagacaactgggctatccgaaaaccactccacaaagaaaccatatctggcaaggtccacctcagctacaaaaccccagcaaagggtaaaatactgaccgccaccagaaaggtgctcgactcatcaatggattttaagagcatcgagaaaatcaccgacacaggaatccagaaaatcctcaaaaactacctcgaatataaaaagagccccgaactcgccttctcaccagaaggaatcgaagaactaaacgcgaccatcaccaaatacaacaatggattccaccacaaacccatctataaggtgcgaatatacgaggaaggagttaaatttcccttaggcaacaaaggaaacaagaaatcaaaatatgtagaagctgagaaaggcacgaacctctttttcgccatatataaagaccaagaaaacaaccgctatttcgagacaattcccttcaacgacgtgctggaaacactgaagaaggggatgtccgcagtaccagagaaaaatcaagaagaaaacaccctagtgtttgccctctcgccacaggacctagtcttcgtgccgacactagacgaaatagaaaacccagacatcgtcgatttcaagaatctaacaaaagaccaaacgaaccggatatacaaaatggtctcctcctccggaaagcaatgctttttcatcaaagccgaagtggcaacgtctatagtgaacaaaatggagttcagcacctcgaacaaaatggaaaactcaatcgagggcatccaaataaaatctaactgttggaaacttaaactcgaccgcctgggcaccatcacccgagtcatcaagtga

SEQ ID NO: 6867 - RNA, 4383 nt, synthetic construct
  misc_feature 1..4383: note = Cas9 variant
  source 1..4383: mol_type = other RNA
atgaccaagttcaacctaggcctcgacataggtaccaacagtataggatgggccctggtcaatgaggattgcgaaaacaagaaaggtaaaattctagcagccggctccaggataattccaatgacgcaggacatcctggataaattcggaagcggtgcagccaccgagacccagaccgcactcagaacagactatcgaagcaaacggaaactgatccaacgattcctcctgagacgcgaacgcctccatagggtcctcaacgtactagacttcttgcccaagcactacgcggaaagcatcgacttcgaaaagtacctcggaaagttcctgccaaacacagaacccaaactcgtctacaaccagaaccagttcatcttccagaacagcttcttcgagatgctcaaagaatttcaagagaagcaccccgaactattcctcaacaaccagaagatcccatacgactggactatctactacctacgcaagaaagccctctcccagaaaatcgaaaaagaggaacttgcctggctcctactacaattcaatcagaaaagaggctacaatcaactacgagacgaagaagaggaaaacaccccagacaaactcgtcgagttttactccctaaaaataatcaaagttaccgccgatgaagccaaggagggcatcaacaaacgatggtactcaatcaacctagaaaacgggtggatctacagacgcgagtcgaaaacgcccctgttcaactgggagggcaaaaccaaaaactttatcgtcaccaccgatctaaaccaagacggctcgataaagaaagataaagagggtaaagagaaacgatccttccgcgccccatccgaaggcgactggactcttctcaaaaagaaaaccgaaaaggagatctacgaatcaggaaaaaccctaggtacctacatatacgacgcactccttaacaaccctgacctcaagattaaaggcgccctcattaagactatagaccgcagtatatacaaggaagaactacagcagatcatcaacaaacaaaaagaatatcacagcgaactgaataactccaagctatacaaagcctgcctcgaagagttataccccaagaacgaaatctacaagaacgagctaaagaacaaagatatcgcgtacttattcatcaacgacatactctactaccagcggcccctgaaagctcccaaatataacatagggaaatgttcatacgagtcacggaccttcaaaaaggaagacaagaaaatcaccgaatttatccccgccgtggcaaaatcacacccacttttccaggagttccgcctgtggcagtggatcaaaaacctcaaaatatacgaaaagctaaccaacgataactacaccgacttcttcctcactaacgaaagagacatcgaaaaattattcgacttcctgtggaacaagaaagaaatagaccacaagggaatactggaatacttaatcaaaaccaaatttccagacctcaagcctaaacaagtcaaaagtaaagtcaaagaatatagatggaattatatatatgaccacgaaaaagacgaatccaaaaactacccatgcggagaaacgtacttcctcctcaaaaataagctggataaaatcacatcaatacaagacgacttcctcaacaagaaacggctcgaaaacctgtggcacatcatctactccgtcaccgacaaaaagcagtacgaaaaagcactggcaaagtttgcgctaaagaaccagttagacacaaaatccttcgtaaacacattcaaacgcatccccgccttcaaaaacgactacgcaatctacagccttaaagccataaagaaactcctaccccttatgcgcgtagggaaatactggaactacgatgatatagacccaatcaccaaacagaagatccaatgcataataaccggagaagaaaacgatacaatcagcacattagtacgcgagaagaccaaccacttctcaaatgagaacgactttaagaacctgagcctttggctagcaggctacatagtgtacaacagccataacgaaagttccgagatcgagaagtggaaaagcccccaagacatagacacatttcttaagaaattcaaacaacacgctctgcggaatcctatagtcgaacaggtagtgaccgagacactccgagtggtgcgggacatctggctgaagaagggccagggaaagaaagatttcttcaacgaaatacatatcgagctgggcaaagatctcaagaaccccgtagacaaacggcgcaagataagcagtaccaactccaaaaatgaaacaacaaacatcagaataaaggccctactgaaggagttactgaaggaaggcattgagaacatcaaacccaactcaccgaaacaacaggaaatacttaagatttttgaagagggcatcctaaacagcggcatcgacatagaggaggaaatcatcaaaatcagccagatcgcccaaccgacgaagaagcaactccaatactatcggaactggctagagcaaaagtacatctcgccctataccggacaatttatacccttaagtaaactgttcacgtccaagtatgagatcgaacacatcatcccacgatccaaatactatgacgactccctcagcaacaaagtcatatgcgagacagagatcaatcgactcaagaacaaccaactaggttacgagttcataaacaaccacgaaatccgagaaataaccttggaagaggggaagacaatcaggctactgagcccgaaacaatacctggacttcgtgaccacctactacggaaagaacaaggccaaacgcgaaaacctcctcctcaaagagatcccaatacagatgatagaaaatcaactcaacgacacacggtacgtatccaaatacgtcatgcaactactcagcaaaatcgtgcgaaaggaagacggcacggacaatggcaccaacagcattaatatattgtccgtctccggcaaaatcactcgagtgctcaagaccgactggggtctaaacgacgtctggaacgacctcctgtgttacagatttgaacgtttaaacaaaataacaaacactaatctattcaccacatacagcgagcagaaacagaaaataatccccatcgtgcccgaccaatacgcaaaagggttccacaaaaagaaactggaccaccggcaccacgccctcgacgccatactaatagcgtgcatcactcgaaaccacatcaactatatgaacaaccagaacatccaaggcgaaaaactcaaaaactttaaaatcgacaagcataactatcatgagatattccagaaatcgcgactcgacatgcgcgcacaactctgcgagaaaaagtataacgaccacgacagcacaaaatacacatgggtcttcaccaaaccctgggccgacttcaccgaaaacattaaagacacactcgagttcatcatcccatctttcaaacaaaatctccgaattatcaacaagacggtaaactactacgaaaagtacaacgaaaacgggaagaaagtgaaggtccggcaaaccaaaggcgacaactgggcaatccgcaagccactacacaaagaaaccatatcaggtaaagtccacctactatacaagacccctgcgaaaggaaagatcctcacagccacccgaaaggtactggacagctccatggatttcaaatcgatcgagaaaatcaccgatactggaatacagaaaatcctgaaaaactacctaaagtacaaagaaagccccgaactcgccttctccccggagggcatcgaggaactcaacatcaccatagcaaagtacaacgacggtttctaccacaagcccatctataaggtaagaatatacgaggagggcgtaaaattccccctcggcaaccgcggcaacaagaagaacaaatacgtcgaggccgagaaaggaaccaacctattcttcgcaatttataaagatcaggaaaacaacagatacttcgaaaccatccctttcaacgacgttctagaaaccctgaagaaagggatgtccgcagtcccagagaaaaaccaggaaaagaacactctagttttcgcgttgagtccgcaagacctcgtcttcgtgccaacactcgatgaaattgaaaaccccgatatagtcgacttccgcaacctgaccaaagatcaaaccaaccgcatctacaagatggtctccagctcaggaaaacagtgcttctttatcaaggcagaagtagccacctccatcgtcaacaaaatggagttcaccaccagcaacaaaatggaaaacagcatagaagggatccagatcaaaagtaactgctggaaactaaagctcgaccgcctgggcactatcacacgcgtcatcaaatga

SEQ ID NO: 6868 - RNA, 4389 nt, synthetic construct
  misc_feature 1..4389: note = Cas9 variant
  source 1..4389: mol_type = other RNA
atgacgaaaaacatactcggtctagacctcggcacaaactcaataggctgggcactgatcaaacaaaacttcgaaaataagcagggcgaaatcctcggcatgggatccagaattatacccatgtcgcaagacattctgggcgacttcgggaaggggaacagcgtctcgcaaacagccgagcgaacgaaatacagatcggtcagacggctacgcgaacgcttcctactacgacgagaacgactccacagggtcctcaacctattgaacttcctcccccagcactacgcctcacaaatcgactttgagaaacgattcgggaaattcaaagttgaaacggaacccaaactggcctggaaaaacatcgacgggcaattcagtttcctgttccaaacctcattcaatgaaatgctggaggatttccgcgtaaacggacaagacgtcaaaatcccgtacgactggacaatatattatctccgcaagaaagccctaagcaagaagatcgaaaaagaggaactagcctggattctcctgaacttcaaccagaaaaggggatactatcaactccggggcgaagaagaagaagagaaccccaacaaactcgtcgagttctactccctcaaagtcgtagacgttgtagccgacgaaccacaaaagggcaaattcgacatctggtattcactgatcctagaaaatgggtgggtctaccgacgctcatcaaaaatccccctcttcgactggaaagacaaaactcgcgacttcatagtaacaacagatctcaacgacgacggatccattaagaaagacaaagacggtaacgaaaaacggagcttccgagcccccagcgagaacgactggaccctagtaaagaagaaaactgaacaggagatcgaacaatcgaggaaaacggtgggaacgtacatctacgaggctctcctagacaacccgaaacagaaaataaaagggaaactcgtacgcaccatagaacgcaaattttacaaggaggaactacgtcaaatactggaaaagcagaaagagttccaccaggaactacagtccgacgacctatacaacgactgcgtccgagaactatacaggaacaatgaggcgcatcaactgaccctcagcaaaaaggacttcgtacatctgctaatggacgacctgatattctaccaaaggccacttcgcagccaaaaatcaagcgtgtcaaactgcaccctagagttccgcaagtacaaggatgaaaatggcgcggaacacacgcagtacctaaaggccatccctaaatcgaacccgtactaccaggaatttcgcctgtggcagtggatctacaacctgaacatctatcgccgcgaggatgagcaaaacccaatcacgggagagttcctatcaacgaccaaggaatttgagaacctcttcgagttcctaaacactcgaaaagaagtagaccaaaaagcgctcctcaaacacttcaaactcaacgacaaaacccacagatggaacttcgtagaagacaagaaatacccctgcaatgaaaccaaaactatgatctcgagtagactcgagaaggtcgaaaacattagcgacgacttcctcactcgtgaaatagaacagaaaatctggcacataatatacagcgtcaacgataagatagagtacgagaaagcactaaagagcttcgccaagaaacaccacctcgacgagagctccttcttcgaagcctttcgcaaatttccaccctttaaaagcgaatacggatcctttagtgaaaaagcagttaagaaactcctcccattaatgcggcttggtaaatactggaactacgcggacatagacaaaagttcaaaagagcgcatccagaagatcattagcggagagtacgacgaaaatatcaaagaccgagtacgggaaaaatccgtccacctcactaccgaaaacgatttccagggcttacaactctggctagcccagtacatcgtctacggcagacactccgaagcgagcatgataggcaagtggaatagcgccgacgacctagaggagttcctgaaaaatttcaagcaacactcgttgcgtaatcccatcgtcgagcaggtcataacagaaaccctacgagtagtcaaggacatctggctcaaatacggaaacggggccaaggacttcttcaacgaaatacacatcgaactgggccgcgaaatgaaactacccgccaaagagcgggaggacctcaccagaaaaataaccgaaaacgaaaacacaaatctgcgaatcaaagcactactcgcagagatgatgaatgacagctccgtcgagaacgtccgcccattcagccccatgcaacaggaaatactcaaaatctacgaagacggggtattaaattccggcatagaaatagaagacgaatacctcaaaatcagcaaaaccgcccagccgtcgccctctgaccttaagcgatacaaactttggctcgagcaaaaatacaaaagcccgtacactggccaaataatacccttaaacaaactctttacgcctgaatacgaaatagaacacatcatcccccaatcgcgttacttcgatgactccttctccaacaaaatcatttgcgagagtgccgttaacaagctcaaagacaactacatcggcctcggcttcataaaacaattcggaggcaccatcatcgaactaggcttcggaaagagcgtgaaagttttcgaaactgaggagtacgaagacttcgtgaaaaagcactacgcgaacaaccgcagcaaaagaaacaaactcctcctagaagacattccagaaaagatgatcgagagacaaataaacgacaccagacacattagcaaatacatatcgggcgtcctctctaacatagtccgaatcgacgatgaccaagccaagaagataatagaagatgcagagatcctcgcccgtaaagagatcgataaagacaaagcaaacgaaatccggagaaaagccaaatccctagccacagacgacgggatcaacagcaaaaacatagtccccggaaacggaaaaattaccacacaactaaaacaggactggggcctcaacgacgtctggaacgacctcatcctgccccgattcgagcgcatgaaccaactgacaaattccaaagacttcacggtctggaacgaaaaccaccaaaagtacctgcccaccgtcccaatagagttctcaaagggattcagcaagaagcggatcgaccaccgccaccacgcccttgacgcactggtaatcgcgtgcgccacgaaggaccacgtaaacctactaaataaccagtccgccaaatccgacaccaagcgctacgacctgaaaaagaagctcatgaaattcgaaaaagttgtctaccaccacacacaaactggaaacaaaattgagcgggagatacccaaacagttcctgaaaccatgggagaacttcaccttcgacgccaaatacaacctagagtcgatcattgtgtcttttaaacaaaacctgcgagtgatcaacaaagcgaccaactactacgaaaagtacgtcgagaaggacggaaccaagaacaaaggccgcgtggaacagactggaacgaactgggctatacgcaagccaatgcacaaagacacggtctccggaaaagtaaatctcccatgggtgaaggtcccaaagggaaaaatactcaccgcaactcgaaaaatacttgacacatcttttgaccttaaatccatcggatcgatcactgacaccgggatacagaaaattctacgaaactacctcgagttcaaaggttcccccgaactagcattttccccggaaggcatcgaagacctaaacaaaaacatcgaaaagtacaacgacggaaaaccccaccaacccattaacaaagtccgagtctttgaactgggcagcaaattccaagtgggacaaacggggaacaaaaaggacaaatacgtggaagcggcgaagggaaccaaccttttcttcgccgtctacgaagacaagaatggaaaacgatcctatgaaaccatacccctgaacgaagtcatcgagaggcagaagcaaggcctctcagtcgtggatctgaaaggaaccaacgacttctacttgtgccctaacgacctcgtttatatcccaagcgacgacgagctcgagaacattaacaacatcgacttcaagaacattgccaaggagaaaaatgaacgaatctacaaagtagtatcgttctccggctcccagatattcttcgtccgccaagacatcgcaacaagcatcgtgaacaaagcagaactttcaaccctcaacaaaatggaacgcgcgatggacggttcgatgatcaaagaaagctgcgtaaaacttaacgtagaccggttaggaaatatcagcaaagcatga

SEQ ID NO: 6869 - RNA, 4401 nt, synthetic construct
  misc_feature 1..4401: note = Cas9 variant
  source 1..4401: mol_type = other RNA
atgacgaaaaatatccttggcctcgatctcgggacaaatagcattggctgggccctaataaaacaggatttcgagaacaagcagggcgaaatccttgggatgggcagccgcattatacccatgtcccaagacgtgctgggcgaatttgggaagggcaacagcgtaagccaaacagccgccagaaccgattaccgaggagtgagacgactacgcaagcgcttcctgctacgacgggagcggctacaccgcgtcctcaacgtgcttaactttctcccggtgcactacgcctcacagatcgacttcgagaaaagatttggaaagttcaaagaggataccgagcccaagctcgcatataacaaagagggcttcatattcaaaaacagtttcgaagagatggtcgcagactttcgcaaacaccaacctcagctgctggaaaacgacaagaaaattccctacgactggacgatctactacctacggaaaaaggctctgtcaaagaagattgagaaagaagaactcgcgtggatcctgctaaatttcaaccaaaaacgggggtactaccagctccgcggcgaggaggaagaggaaaatccaaataagctggtagaattttacagtctaaagatcacagacgtccttgccgacgaaccacaaaagggcaaaagcgacatctggtactcgctaattctagagaacgggtggatctacagacgaagctccaagacaccactcttcgactggaaagagaaaacacgggactttatagtcactacggacctgaacgatgacggctcgatcaaaaccgacaaagatggcaatgaaaaacgtagcttccgagcaccgtccgaaaatgactggaccctagtaaagaagaaaaccgagcaggagatcgacaagagccagaaaacggtcgggacctatatatacgaaaccctgttacagaacccgaagcaaaagatcaaaggaaaactcgtgtgcacaatagagcgaaaattctacaaggaggaactgaaacagatcctagagaaacagaaggaatttcaccaggagctccagaacgacgatctatattccgactgcgtccacgaactctaccgcacaaacgaagcacaccagctcaccctttcaaagaaggaaatagtaaacctctttatggaagatctcatattctaccaacgcccactacgttcacaaaagacgagtatctcgaattgcaccctcgagttccggaaatacaaagacgagaatggggtcgaacacacccaattcctaaaagcaatcccaaaatcgaacccatactaccaggagttccgaatctggcagtggatcttcaacctcaacatctacaaaagagacgacgactcaaacgtcaccaaagaatttctcaacacgacagaagacttcgaaaaccttttcgagttcttaaacaaccgcaaagaagtagaacaaaaggccctactcaagcacttcaaacttaatgaaaaactccaccggtggaacttcgtcgaagacaagaaatacccatgcaacgaaaccaaaacgatgataagtacacgccttgacaaggtcgaaaacatcagcaaagactttttcacgagagaaatagaacagaagatatggcacatcatctatagcgtcaacgacaaaatagaatatgagaaagcgctcaaatcctttgctattaagcacaacctggacgagaacagcttcttcgaagcgttcaaaaagttcccaccgtttaagagtgaatacggcagcttcagcgagaaggccatcaagaagctcctcccactcatgaggctagggaaatattggaacgaagacgagatcttgaagtacagcgacgactacttcaagaacatcgaaagcctcctcggcgtactgaaacagcgagacgaaaacataagcgatgccgaccgcgaaaactacaacaagacgatcaacaacaaacttcgcgcagaactcgaaaacttccaaaacgccgaaatcgaatcgttccaggggctcagactccacatagcacaatacatcctgtatggcaaacactccgaaggggacaacaaaaagttcaacagcgcagacgacctggagaaattcctcaaggagttcaagcaacactccctccgcaaccccatagtcgagcaagtaatcacggagacacttcgcgtagtcaaggacatctggaccaaatacgggaacggcgcaaaagacttcttcgatgaaatccacatcgaattaggcagggacatgaagaaaacccgggacgaacgagcagacgccaccaagatcatcacggagaacgaaaatacaaacctacggataaaagcgctgctagcggaaatgatgaacgacgtcgaaatggagaacgtacggccctacagcccaatgcaacaggagatcttgaagatatacgaagacggaatactaaagtccgacatcgagatcgaagatgacatactcaaaatatcgaaaaccgcacaacccagcagttcagacctaaaacggtacaagctatggctcgagcaaaagtacaagtccccttacacaggccaaataattccactgaataaactcttcaccccggagtacgagatagaacacatcattccacaatccagatacttcgacgactctttctctaacaaaattatatgcgagtcggcagtcaacaagctaaaagacaactacatcggcctaggcttcataaaacaattcggtggaacaatagtagaatgtgggtttggtaaaaacgtcaaagtgttcgaagccgaagaatacgaggacttcgtaaagaaacactacgccaacaaccgaggaaagagaaacaaactactcctggaggaaataccagagaaaatgatagaacgacaaatgaacgatacccgacatatcagtaaatacatcagcggcgtcctaagcaacatagtgcgcgtagaagacggctcagacgaaggagtcaactccaaaaacatcgtgccgggaaatggcaagatcaccacccaactaaaacaagattgggggttaaacgacgtatggaacgaactaatactcccgcgatttgaacggatgaaccagctaacaaactcaacagacttcacagcctggaacgagaaccaccaaaagttcctaccaacggtcccaatcgagttcagcaaaggattctccaaaaagcggatcgaccaccgccaccatgcactggacgccctgataatcgcctgcgcgaccaaagaccacgtgaacctcctaaataaccagagcgcaaagagcgacaccaaacgctatgatctgaaaaagaagctcatgaaattcgaaaaagtagtttacaaccacccccaaacaggagaccgcatcgaacgcgaggttccgaagcaattcctgaagccctgggacaactttacgttcgaggcgaaaaacaacctagacaaaataatcgtctcattcaaacaaaaccttcgcgtgatcaacaaagcaacgaactactacgagaaatttgtggaaaaggacggcgtcaagacgaaagagcgcgtcgagcagaagggaaccaactgggcaatacgaaagtccctacacgaagaaaccgtgtcaggcaagatagacctcccatgggtggaaacaaacaacggcgagttcatcaccgccacccggaaatcgctagacgcctcgttcaacctcgagaaaatcaagaaaataacagacacaggcatccagaaaatcctaagaaactacctcaaagcaaaagacgacaatgcagaactcgcgttcagtcctgaagggatcgaagacctcaacaaaaatattgagaagtacaacgatgggaaatctcatcaacccatcgtgcgagtccgggtgtacgaaaaaggtaaaggcaggtttgcgctcggccaaacagggaacaatattgacaagtacgtacagggcagcccgaacctattcttcgctatctacaaggatgagaacggaaagaaatcctacgaaagcattaggctagacatagtgattgagcgtatgaaacaggggctgcaagccgtaccagaaacgaacccgaatggcatatcgctgtaccaaaacctatctcctctcgacctcgtgtacatacccacagaagatgagatcgaaagtccccacctgatcgattttacaatccttaacaagacgcggctggagaggatctacaacgtaaacgatttctccggctacaccatctatttctcccaaaactccttcgccaagaacatctaccccaaagagatggacatgacgtggaacgaaaagaaacagaaaccctcgggcagcttcgattcgaaaacagcaagctacaacaagaaatcgataaaagacatcttcataaaactaaaaatcgaccggcttggtaacataagtaaagtcagcaacacgctctga

SEQ ID NO: 6870 - RNA, 4401 nt, synthetic construct
  misc_feature 1..4401: note = Cas9 variant
  source 1..4401: mol_type = other RNA
atgaaaaacatactcggcctagatctaggaaccaactctatcggatgggcactcgtgaaagaagacttcgaaaacaagcagggagaaatactgggcctcggcagccggatcatccccatgtcgcaggacatcctgggcgagttcggcagaggcaactcaatatcgcaaaccgcagatcgcactggctaccgtggggtacgacgcctcagagaaaggcacctcctacgccgagaacgcctccaccgagttctcaacatactcggcttcctcccgaaccactacgcaaaggaaattgacttcacaaaaaggctaggtaaattcatcaaccacgccgagccaaaactttcatttgataaggagttcatcttcaaagacagcttcaacgaaatgctgaaagattttcagcaaaaccaaccgggctttataataaacaaacacggcgaagaagccctcgtcccatacgactggactatctactacctccggaagaaagcgctcacccagaaaatagacaaagaggagcttgcatggatcctactgaatttcaaccagaaacgcggctactaccaactgcgcggggaggaagaagaggaaaacaccaacaaacttgtcgagttctactctctcaaaatcatagacgtcatcgcagacaacgaagtgaacaagaaaggagaagtatggtacagcctacacttggagaacgggtggatctaccgtcgttcctccaaaatctcccttgtcgattggaaagacaaagtgagagatttcatcgtaacaaccgacgtgaacgacgacgggtccgaaaaactagacaaagatggggtggtcaagcgcagcttccgggcgccaagcgcggacgattggaccctgttaaagaagaaaacagagcaggacatcgacaactcgaacaaaactgtaggggcgtacatctacgagaacctactgcttaacccaaaacaaaagataaaaggcaaacttgtacgcaccatcgaacgcaaattctacaaagacgagctgaaacaaatactcgaaaagcaaaaggagttccaccaagaactccaaaacgaacaactcctccaggactgcgtccgcgagctgtacaaatacaacgagcaacaccaacaaatgctggagagcaaggactttgttcacctgttcctcaacgacatcatattctaccaaaggccactacggagccagaaatcacttatctccaattgcaccctcgaaaaacgcgtctcacgagacggcgtggtgtttccaataaaggtaataagtaaaagcaacccgtactaccaagagttccggctcctacaatggctccaaaacctcgctatctaccgcaaggacgacgacgtaaatgtcacccaagagttcctgaacagcatcgaatcctgggaaaacctccttcagttcctcaacgctaagaaagaaataaaacaggagcaactcatcaagttcctactagagcagaaagggctcaagggaaattccctgaaaaccgcaatccttacctaccggtggaactacgtcacggacaaggtctaccccatgaacgaaacacggtccctaatacaagacaagctcaagaaagtagaaaacgtggcgacagatttcctcagcttcgataacgagatggcattgtggcacataatctatagtgtaaatgataaaatcgaatatgaaaaagccttagcaaaattcgcaagcaagcacaacctcgatgaaatcagcttcgtagagagcttcaaaaagttcccacccttcaagagcgactacgggtcgttctcggaaaaagccataaagaaactgctccccctgatgcggttcggctccgtatggaataaaaacaacatcgtacccagcgtattggaccgaatagataaaatccttacaggcgaatacgacgagaaaataaaaatcagagtacgcgaaaaagcagaacaattccagttaaaccaaatagaagacttccaaaacctccccctctggctggcacaatacgtggtatacgacagacatagcgaagcggaaatcgcgggcaaatggaacagcgtgaaagacctcgaaaactacctcaaagagttcaaacaacactcccttcgcaacccgatcgtagaacaaatcatcaccgagaccctccgagtagtcaaggacatctggcaacaatacggtaatggcgttcaaaacttcttcgacgaaatccacatagaactaggccgcgagatgaagaacacagccgacgagcggaaacgcataacaaactcagtcacagaaaatgaaaacacgaacttgcgcatcaaagcgctgctagtggaattgaaagaagacaccaatattgaaaacgtacgcccacactcccctatgcaacaggaaatcctcaagatctacgaagagggcgtgctaaatgctgtagagaacattgacgaggacatcctaaaaatatcgaaaactgcacaaccgtcaaagtcagaactcatacgatataaactatggctcgaacaaaaataccaaagcccctacaccggggaaatgatccccctctcccgactcttcacctcagactacgaaattgagcacgtcataccccaatccaggtatttcgacgactccctctcgaacaaagtgatatgcgaagctgccgtaaataagcgcaaagacaatcaactcgggctggagttcatcaaaaaccaccactcagagaaaattgaactcggcaacggacgtacggcccaggtacttgaagtggaagcatacgaatccttcgtgaaaaagaactacgacaagaaccggggaaaacgcaacaagttactactcgaagatgtacccgaaaagatgatcgaacgccagctcaacgatacgcgttatatctccaagttcgtcacccatctgctctccaacatcgtacggaaggatgaagtgaatagcaaagatgatggaataaacagtaaaaacatcataccgggcaacgggaaaataacatcacaacttaaacaggactggggccttaacgacgtatggaacgaattaatacttcctcggttcgaacgcatgaacaacctcacgaactcgacagacttcacatccaccaacaccaatggcaaaataattcccacagtcccactcgaatacagtaaaggcttctccaagaagcgaatcgaccaccgccaccacgcactggacgcactcgtcatcgccctcgcaacgcgcgaccacgtcaacctactgaataacgaatccgcacttccgaaaaaggaccgaactaaggaagaacaaaagagcttcaggttcgacctacaggtaaacctccgtaacaaagaaaaatacttcaacgtcaaagaaggccgcgagaaagaaaaattcaccaccttcaagaaaccctggaacaccctaacacaagacacgcgggatgccctagagaacatggtggtatccttcaagcaaaacctgcgcgtcataaataaagccacaaactactacgaatcatacactgacgaaaacggcaaccttcgcctagacaaatacgggaaccccaagaaggaactaatcagccagaaaggaacgaactgggccataagaaaatcacttcacaaggaaactgtgtcaggccaaattcaccttgaccgagtaaaagtcaccaaaggcaaaatcgtgaccgccacacgtaagagtctcgacagcagtttcaacgagaaatcgatcgaatccatcaccgataccggaatccagaaaatcctgcgcaactacctaaaagcaaaagacaataagcccgacgtagcgttcagtccagaaggcatcgaagaactcaacaagtccatatccgtctataacgaaggcaagaatcaccaaccaataataaaagtcagaatcttcgaacaaggctcaaaatttccggtaggagaaacaggcaacaagatagccaagttcgtcgaagcagccaagggcacaaacctattcttcgggatttatcaagataaaaccggcaagcgctcatatgacacaataccactgaacctagtcattgagcgactaaagcaaggacttagtccagtccctgaaaccaacgagaagggacaccagctactcttccacctcagccccaatgacctcgtctacgtgcccacaatcgacgacaacgagcaactcgactccaaccgcgtctacaaattcacagacagcagcgacacaacctgcaacttcatcccctccaacatctcagcaataatattcaacattaattcaaaagagcaagagaaaaggggcatcaattacccgatacagaatgaattaggcgtcggaagcccacaatcgaagaaccaaaagagcttcgacgggttcatgatcaaggaagtatgcataaaactcaaagtggaccgactcggcaacattagtaaaacctga

SEQ ID NO: 6871 - RNA, 4416 nt, synthetic construct
  misc_feature 1..4416: note = Cas9 variant
  source 1..4416: mol_type = other RNA
atgtgcaaatacttctacatcaaaaactttatcacgttcgtactatcaaaatcgatcatcccaatgaagcacatcctagggcttgacttagggtctaactctataggttgggcgttcgtgcaacaggacttcgagaacaaacaaggaaaaataattgcaaccggcagtcgaatcatcccaatggaccaaggcatcctcggagacttcgaacgcggaaacaccgtaagccagacagccgaaagaaccacatacagatcgacccggcgcttgcgcgaacgccatctactacgcagagaacgactccatcgggtccttcatatacttggattcctcccaccccattacgacgcgcaaatcgatttcacaaaacgctacggcaaattcatcgacaacgctgaacccaagatcgcatacaacaacggcaacttcatattcatgaactccttcaacgaaatgatagaggactttaagaagcaccaaccacaactgttctacaagaaatcgaatggcgaagaaagcaaaatcccatacgattggactatttactacctccggaagaaagcactgagccagaaaataactcaacaagaacttgcctggctcatactacactttaaccaaaagcgaggttactaccaactccggggagaagaagaaaccgagaatccaaacaaagaggtggccttccacagcctcaaggtagtggacgtggaagctgaggcgcccaacaagaaaggggaaatctggtacaccatccgactcgaaaacggatggatatatcgacggacatcgaaaataccactcgatgactggaaaggcaagaccagagacttcatagtcacaacagacctcaacgacgacggcacaatcaaagtggataaggaaggcaaagaaaaacgctcattccgggcccccgacgagaatgactggaatctactgaaaaagaaaacagaacacgacatcgatttctcagggaaaaccgtcggcgcctacatatacgaccatctcctccagaacccgaaccaaaagataaaaggcaaactcgtccgcactatagagcgcaagtattacaaagacgaactaaaggcgatactagcgaagcaaatcgccctccagccagaactcttcacagaaacccttttggctgactgcattcgcgagctataccgaaagaacgaaacgcagcaacagaacttgcttagcaaagacttcctacacctattcgtagaggacatcatattctaccaacgacccctgcgcagcaagaaatcaacaatcgccaactgcaccctagagaaaaggtcctacattgacaaagagactaacgagagaaaagacgccccgattaaagtatgcgccaaatccaacccatactaccaagagttccgagtactacaatggctccaaaacctacggatctacgaaatcgagactgaccgggaagtaacggccgagttcatcgaaacaccccaggactgcgaagccctcttcaactttctcatgtcgcaaaaagaaatagacaataaaggactgctgaaatacttcctcttcgcgaaaaacccccaaatcaaggataaagcagctaaatcggaactgaagaaatggctcaccacctaccgatggaactacgtgtacgacgcagccgacaactctagcaagaaatatcccatgaacgaaaccggatacgaattacaacggtacctacagaaagtcgagggactacccgcaaacttcctgaccttcgacatcacctaccaactctggcatctcctgtactcggtcaaagacaaagtcgagttcgaaaaagccctcaagaaattcgccaaaaagaaacagctcgacaaaacgagcttcgtagactccttcaaaaacttcaaaccctacccaaacgagtacggcagcttcagtgagaaggcgataaagaaactacttccactcatgaggttcgggaatcactgggacttcaaccgcatcgatgtttccacacagaaacgcatcgacgacctgataaacggagtggccaacgaagacatccgcaccatcatcagagaaaaggccgagaagtaccagcttaactccgagacgtgtttccaggacctacccctatggctagcccaatacgtcgtatacaaccggcacgcggaagccaccgatatagaaaaatggactagcgtaagcgacctcgaggcttaccttgaagacttcaaacaacactcgctacggaatccaatcgtcgaacaagttgtcaccgaaacactacgggtggtaagagacatctggcagcaatatgggggaggacaagccaacttcttcgacgaaatacatatcgaactcggaagagagctcaaaaagacagcagaggaacgaaaacagctcagcgataaaaaccaggaaaacgaatccactaatctgcgcataaagaagctgcttgccgagctcaaagaggatgcctccatccagaatgtccgtccatacagcctcgtgcagcaggaactcctcaaaatctacgaggaaggtgtcttcagcgcaaccgacgaagttgaggaggacatacagaaaatccgaaagaaagcggaaccctcgaaagcagacttacaacgatacaaattgtggctcgagcagaaatacaaatccccgtacacgggggaagtaatctccctgactaaactattcacagaagaatatgagattgaacacattataccacaatcccgatactacgacgactctctctccaacaaagtgatctgcgaaagcgcagtaaacaagctgaaaaccaaccaactaggcctagagttcatccaaaaccaccatggagaaaaggtccgaatcaccgccaacaaagaggtcaccatctttacagaggaacagtacaaagagttcgtcaagaaacactacgccaacaacagcgctaaacaacaaaaactactccttaacgagattccagagaaaatggtcgcgcgtcagctcaacgacactcgctacatatccaagtacatcagcgagatcctatccaagatagtccgctctgacgaaaaggacgaaggagtcaactccaaaaacataatcccctgcacaggaaaaatcacgaccgcgctaaaacaagactgggggctcaacgatgtctggaacaaactaatcttacccagattcgagcgcatgaaccaactcacccagacacaactatttacttcatacaacgaccgcctccagaaaaacctcccgactgtccccatcgaatactcacaaggcttccaaaagaagcgaatcgaccaccgacaccacgcaatggatgccctggtaatcgcctgcgcgacacgggagcacatcaattacatgaacaaccaacacgcattagacaagtcaaaagataagaaagaaaaacaacagtcccgcatagacctacgcaccatactatgtgagaagaaaaacaacaactggcagttcaagaaaccctggagcaccttcacacaagaagcaaaagaagccctcgaacacatcgtagtatcgttcaaacaaaacctcagagtaataaacaaagcaacgaactactacgaaaaatgggaagagaaaaacggagtcctagtcaaaaagaaagtcaaacaagaagggacaaactgggcgatccgcaaaccactacacaaagagacggtcagcggtaaaatagtacttgatcgaaagataggcaaagataaaatcctaacagccacgcgcaaagcggtcgacataacgttcaccgagaaaatcatcagctctataaccgacactggaatacagaaaatacttctaaactatctaaagtacaagggcagtccggaagtggcattttcgacagaaggcctcgaggaactgaacaaaaacatcgcccaatacaacaatggaaagaaacaccagccaatatacaaagtacgaatcttcgaagaaggatccaaattccccctcggcgaaactggagccaaggccaccaagtacgtggaagcagccaaaggcaccaacctatttttcggagtataccaaggcaaaggcaaaagaacctacgcgaccataccgctcaacgaagtcatagaacgccagaaacaaggactgccgagcgtccctgaacgaaacgagaagggcgagccactactctttagcctatctcctaacgatttagtctacgtcccaatggagggtgaaatcgccgagaccatcgacttcaacaacctctccaaagaacaaaaagaacgcatttataaaacagtttccttcaccggcaaccaatgcttcttcgtacaggaggccgtcgccacccccatcgtaaacaagatggaatactccccgctaaacaaaatggaacgcgacatccttggcaccatgatcaaagaggtatgcatcaaactcaaggttgaccgacttgggaacatcacgaaagcctga

SEQ ID NO: 6872 - RNA, 4416 nt, synthetic construct
  misc_feature 1..4416: note = Cas9 variant
  source 1..4416: mol_type = other RNA
atgggctacaaggcgcccaggaacgacaagggggaaatagactacggcgtcggcctcgatctaggaaacggtagcgttggctgggtagccatggacaaggactaccacctcatccgagcaagaggccacgaactcatcggagcacgactattcgaccccgctaacagcgcagaaaaccgacgcgaatcaagaaccactcggcgcagactctcacgcagacgctggcgcctacgaatgctagatagcttattcgcatcagagctcgcgaaaatagaccccaatttcctcgcgcgccgcaagtactcgtgggtacaccccaaagacgaacaaaatcacgaaaactggtacggcagtataatcttcggatcgaaggaacaagacaaacaattctacaaggattaccccaccatataccacctccggaagaaactcaccgaggacactgaacgccacgacataagagaaatctacgtcgccatacaccacatcgtcaaatacaggggccactttctaagagagggagaaatcaacagcgaaaatctcttcgacccagagggatttgtagaactcataaaagacgtcataaaattgaataacagctatgacgaatccacaccaatatttgaggcaagccctgccgacgtaagcgaggcgttgctgaacgaacacacatcccgctccggcagaatcgaagacacactcgacaaactagatttcagcgtaagccgcgtcgacaaacatgagctcaaaggaatgcgcgacgccgccaaagcagtcattggcgccatcgtgggtaacaccgcagacttctccaagatcttcaacctcgacaatctagacaaagactccaaagacaacctgaaactaaagttcgccgacagcaacttcgacgaaaaatacggtggcgtcgtgggctccggactccttgacgaaacccaaatcgagctagtcgacaggatacatgcggtctatgacgcagtggccctgaaggggatcctcggcgacgctcacaccatctcagaagctaaggtcgaaagttacgaaaaacatcggaaaaattggaaactcataaaagaagaacttcgcacaaaagagaacaaagacgaggtcgatctctggtacggtgacctttccggaaggcaatacaaaaacccaccggacccagaaaagggacccgacgaaggcagcaagaaagacagcccgatccgcgattcagatcagaagcaaaacctgattaagaaagccaacgactacttcacggagctcatagacgactcacaactctcagaagaacaaaagaattgcctcaagaacgacataaataacggacaactattcccagtacagcggagctcggacaacggcgtaatcccataccaaatacacctaaatgagctccgacggattatagagaaccagaagcaatactatccattcctcgccgaaacctttattcgcaaaacagcggagggcaaaagttacgaagagaacaagatcgtggcccttcttaaattcagagtcccatactacgttgggccgctcgtctccaaagaagacatggaggaacacagctcaggcaactccgcttaccactggatggcacgtaatcccggccgaggagaggcaatcaccccctggaatttcgacgaggttgtagacaaagacgaatcaggcgccagattcataagccgtctcacgggcacagatacatacctcttgggggaacccacactgccccaacactccctgctctacgaagagtacatggtccttagcgagcttaacaacgtgcgccttaacgtaagacagggaaaccactggagcgataaaaaccgccaacgactttcgtacaaacaaaaagagttcctcatcgaaaacctattcaaagaacacaagaccgtaacccgcaaacgggcagaggactgcctctccagcatgggctgcggcgaggtccaattattcggactgtcagacgagaaaaagttcgcatccagccttagcagctacatcactcttaaaaagatactaggcaaagcgttcgtagacgactccgggaacagtgccatcttagaacgtattatagaagtgcaaacggtattcgaagatagagaaccactcacccaccaactcagcctcatcgactcgttaaccgtagaacaaagaaaacagctcgcaaagattcactacacaggctgggggaagctatccagaaaattgctaaccagcaaaaagggttcatacaaaatccactcgcaaaacgaaattatgagaacacaacatagcatcatcgacataatgcgaggggacagccttaatttgatagaaataatcagggacaaaaagatcggaatcggagagtggatagacaacgaaaacctagacagagagaccggagagtccgatgttagcagactagagtcagtcttcgaaggaatcgtgatgtccccaagagtcaaacgaggagtagtacaagcagtccgcgtaatagatgacctggccaaggccataggaaacccgccgcaaaggatattcatagagatggccgacgaagtacaagctagtcaaagaactgtctccagactgtcccgtctcaaagcgctctacgggagcccatcactacagaaggaatttaatgacctcaaagatctgcgaaaatcgcttaacgagaccaaagatgcagacctccaagaagaccgcctgtacctatactacatacaactaggcaaagacctctacacaggcaaggaaatcagcatcgactctctcagcagcgcatacgacatagaccatatagtaccacaagcactcactcaagacgacagcatagacaatagggtgctcgtaagcagaaaagaaaacgccagaaagaccgactcctacctatacacacccgatctcataaagaacatgcgacccctctggggcaaactactggcagccggcttaatgtcgcaaaagaaatacgacgcactgacgcgtgtagacgacttcaaagaccgggaaaaacagcgcttcgtacagagatccctggtagagacgaggcagattatgaaaaatgtgtcaaccatactgcgaacctactacggagaagacaccaacgtcgtgaccctaaagtccagcatcacccacgacatgaggaaatacctgggcttcccttacaaaaacagagacatcaacgactaccaccatgcccaggatgctctctgcataagcgcggcaggccagttcatgctgaaccgtcacttcgtctcaggcggggaggttacggacggggcctcaaacgcgtataacatgtacctcgcggaatacttacaagaatttcgagacgccaaagcacgaggagaacgcaaacgatctaccgcatttggcttcgtcgtcgggagcatgagctccaaggacgacgaaaagcgtacggaccacagaacaggtgaaattgtctggtcggagacaaacgccgagtacctacgaaaagtcatgaactataagaaaatgctgattactcaaaaggtgggcgacgtcaaaacccgagcactctacgacgaaacccgctacgggcataaagagtcaagcgcaaaatcaataaagttcgacaacctacgacgggacacgtcattgtacggaggcttctccggagcatccaccgcgtacatgatgctagtcgagtacaagaagaaaaataagctcgtaagcatcaccgcacaagaagcctcacttctggcagtagccgaccagaaaaacgacaccgtaagcgtaatggatggtatcctagcgtcccacggcctatcaggcgcaaagatcctgttgccaaagatcgtgaccgggcaacttctggactacagcgacgcactcgtaacgctacagagtgcaagcgaactcaacacggcaagacaaatgtggcttcccaggaacgactacaacgacattgacatcatcctaaagtccaaagacatcgaggacgccgcccacaagctggggtacgacagcgacaccgtacacgtactgaggagaatccaaaagctctttgaagccgtctttagagtagcggagtcacaatttcccctccaccaactaagcaaagaccaacaagaagaaatactaagagaccctcaaaactacgggttcggaagcgcggtcaaattactgggcggcctcctgaaagcactccacgcgaacgcagagaacactaacctggcaggcctggtaaaagtactgcatggggataaggaatacagcgacgatggcaaagcgaaagagttcaagaaattcggattctcgcccagatggagaagaataagtaaccccaccggcttcacactctccgactcggacaccttcatataccaaagcccgagcgggatcttcgaacaacgagtaaccgtcaaagaacttaaagaaaaagcggacaagcaaaaatga

SEQ ID NO: 6873 - RNA, 4422 nt, synthetic construct
  misc_feature 1..4422: note = Cas9 variant
  source 1..4422: mol_type = other RNA
atgaagaacatactgggcctcgacctcggcacaaacagtataggttgggccctaatcgagaaagatactgaccagaagaatggaaacatactcggaacgggaagccgcattataccaatgagccaagacataaaggacgagttcgggaagggcaactccataagtcagactgcggatcgcacaaaattccgcagcgtccgaaggctccgagaaagacacctactaaggcgggagcggctccaccgagtgctcaatgtgctgggattcctacccaaacattacgcagaccagatagactttaaaaagaggctaggaaaactcgtgaatgaaaccgagccaaaacttgtctacgataacaagaacttcatattcaaaaagagctttgaggcaatgctgtcagatttcaaccaacaccagcccctcctcctggcggacggcaagaaagttcccttcgactggacgatatactacctacgcaaaaaggcgctcaccgaaaagatagaaaaagaggagctagcatggctcatcctcaatttcaatcaaaaacggggatactaccagctgcgaggcgaagaggaggaggaaaaccccaacaagatggtcgcattccactcactaaaaatcgtcgaggtcatcgcagacgaatcccaaaagggcaaagccgaaacctggtacagcctgattcttgaaaatggatggatctatcgacgatcctcaaaaacacccctctacgattggaagggaaaacaacgggacttcattgtgaccaccgatctaaacgacgacggcagcataaagacagacaaagaaggcctcgagaaacgcagcttccgggccccggtagaggatgactggacattagtgaaaaagaaaactgaacaggaaattaaccgctcccacaaaacggttggcacatacatctacgaaaacctactccaagacccaaaacagaaaatcaaggggaaactcgtgcgcacgatcgaacgagagttctataaggacgaactaaaaatgatactcaagaaccaacaaaaattccaccccgaactgaatgacgaacacctctacattaactgcgtgcgtgaattgtaccgcaacaatcaagcccaccagacgattctaagtaagaaagatttcgtccacctctttatcgacgacatcatattctaccagagacccctccgcagccaaaagtcttcaatttccaactgcaccttggagttccgcaagtataagaacgaaaacgggacagatcagacagactatctcaaagcaataccaaaatcgcatcctctgttccaggagttccgactttggcagtggatctacaacctcggaatataccagaaagaagacgacaccaacgttactgacgaattaatcaaaaacatagacggctaccaagacctgttcgacttcctcaacaacaagaaagaaatacgccaagacatcctcatcaaattcctcgtcgagcaaacgggcctaaaaggcaaacccctctccagcgtagtagccaaataccgatggaacttcgtcgaggataaaatatacccttgcaatgaaaccggcacgcaaatacgcacacgcctcgccaaagtggagaacacgccagaagacttcctaactgccgaaactgaaataaaactttggcacatcatatacagcgtcaacgacaaagcagactatgaaaaagcgcttaaaacattcgccgaaaaacacaaccttgacacacactccttcgtagagaactttaagaagttcccaccctttaaatccgagtacggatccttcagcgaaaaagcaatcaaaaagctgttaccactaatacgtctcggcaaatactggagctgggagaacatagacaagaagacccaagaacggatcgaaaagatccttacgggcgaatttgacgaggctatcaaatcccgcgtgcgagataaagcgatacacctcaccgaagaggaccacttccagggtctacagctgtggctggctagctacgtcgtatacggccgtcacagcgaagcagacaacctagacaagtggcacacagtcgcggacctagaggactatctcgccgaatttcgccagcacagcctacggaaccctatcgtcgaacaagtaataacagaaacactccgggttgtcaaggatatctggctacaatacggccagggtgcaaaagacttcttttccgaaatccatatcgaactcgctagagaaatgaaaaacaccggcgacgaacgcaaacgcctcacatccctcgtaacagataacgagaacaccaatctccgcatcaaggtactcctatcggagctcctcaacgacggaaacgtggagaacgtacgcccctattcccccatgcaacaggaagcattaaaaatatttgaagacggagtgctcaacagtgacattgaaatcgaagacgatatcctaaaaatctctaaaatggctcaacccaccaatacagaactgaaacgctacaaactctggctagaacagaagtatcgcagcccatacactggacaaataatacccctcaaccgcctcttcacagccgactacgaaattgaacatatcatcccccagtcgcggttctttgacgattcgttttccaataagatcatatgcgaatccgccgtcaatcaactgaaagacaagcaactcggactagagtttatcaaaaaccacagtggcaccatcgtaaaactaggaatgggcaagacggcaaagatacttgacgtggaaagctacaacgagttcgtgaaaggaaactacaccaaaaacatctccaagcggaacaaactcatgctagaagaaatccccgacaaaatgatcgaacgccagttaaacgacacccggtacatctctaaattcatcatcagcgctctcagcaacatagtcagatcggaatcaaacgacgacggcttcaactccaaaaacgtcctcccaggcaacggaaaaataacgagccgcctcaaacaagattggggcatgaacgatatatggaacgaattaatcctcccacggtttgaacgcatgaacaaaatcacggacagtgctgtatttaccgcgtggaatgaaaacaaccagaaattcctccccatcgttccgctagagttctcgaaaggattccaaaagaaacgcattgaccaccgccaccatgcacttgacgccctggtcatagcagcgtcgacacgcgaacacataaacctcctaaacaacgaacacgcaaaaagcgacaaacgctttgacctgaaccgcaaactacgcaagttcgaaaaggtagcatataacgatccaaaaaccgggaaacgcatcgaaaaagaagtaccgacaatattcctaaaaccgtgggaaaccttcacagtcgacgcgaagaactcactcgaatcaattatcgtcagcttcaagcaaaacctcagagtaatcaaccgcgcaaccaactactccgaatcctacaacgacgagaacggggcactacgcctcggcaaggatggcaacccactcaaggagaaaataaaacaatccaagggagactcctgggcaatccgcaaacctatgcacaaggacttcgtttacggcaaagtgcatctccagaacgtgaagctccccaaagacaaatttatcaccgcaatccgaaaatccctcgacgtaacgtttgatcttaagcgaatagagaccatcactgacacgggcatccagaaaatcttgaaaaactaccttcatagcaaggagaacaaagtcgaactggccttcagccccgaggggatagaggacatgaaccaacacatagaaagatacaacgacggaaagaagcatcaacccatacacaaagtgcgcgtgttcgagatagggtctcgcttctcccttggagaaagcggaaacaagaagaccaaattcgtagaggctgccaagggcaccaacctcttcttcgccgtctaccaagacgacaacaaaggaaaacgaaattatgagacaatccccttaaacatagtcatagaacgccaaaaactcggcttacacagcgtgccgaccgaagacgctaaaggaggaaaactcctcttccacctctcacctaacgacatggtatacgtgccaacaagcgaggaactcgaggacaacctagcaagcgtgaatatcaagcgactcaacacggcccaaagaaaacgcatatacaaagtcgagaaggcatcaggggtcgaatgctacttcatccgccaggacatcgcctatctaatcaaaaattacgacgcgaagaccaagatcggagaacttgaaagccaaaacaaactacagacaaccatgaccgacgacagactcaaaatcacggacgtctgcgtcaaattaaacatagacaggctaggctccatcgcagaaaccttcctgggaaaccaatacggagccagcaaaaagacctga

SEQ ID NO: 6874 - RNA, 4422 nt, synthetic construct
  misc_feature 1..4422: note = Cas9 variant
  source 1..4422: mol_type = other RNA
atggcaaagatcctggggctggatctgggcacgaactcgatcggctgggccgtcgtagaacgagaaaacatagacttctcactcattgacaagggggtacgtatattttcagaaggcgtaaaatcggagaaaggtatcgaaagctccagagcggctgaaagaactggctaccggtccgcaagaaagataaaataccggcgcaaactgagaaaatacgagacgctgaaagtgctgtcccttaaccgcatgtgcccgctgagcatcgaggaagtcgaagaatggaagaaaagcggcttcaaagactaccccctcaacccggagttcctcaaatggctatccacagacgaagaatccaacgtcaacccctacttcttcagggaccgcgcaagcaaacacaaagtgagcctgttcgaactaggccgcgcattctaccacatcgcacaaagacgcggattcctctcgaacaggctagaccagagcgctgaaggcatcctcgaagaacactgcccgaaaatcgaagccatcgtcgaagacctaatctccatagacgagatcagcacaaatatcaccgactacttcttcgaaacaggaatcctagactccaacgaaaagaacggttacgccaaagacctagacgaaggggacaaaaagctagtcagcctctacaaatcgcttcttgccatactcaagaaaaacgaatccgacttcgagaactgcaaaagcgagataatagaacgcctgaacaagaaagacgtactggggaaagtcaaaggtaagatcaaagacataagccaggccatgctagacggaaactacaagacactaggccagtacttctactcactctacagcaaagaaaagatacggaaccaatacacctcacgcgaggagcactatctcagcgaatttataacaatatgcaaagtgcagggaatagaccagataaatgaggaggaaaagataaacgagaagaaattcgacggcctagccaaagacttatacaaagcaatcttcttccaaaggccactaaaatcccagaaaggcctaataggcaaatgcagcttcgagaaaagcaagtcgcgctgtgccatcagccacccggacttcgaagagtaccgcatgtggacgtacctaaacacgatcaaaataggaacccaaagcgacaagaaactacgattcctcacacaagacgagaaactcaaacttgtcccgaaattctaccgcaaaaacgacttcaacttcgacgtcctcgcaaaagaactcatcgaaaaagggagctcattcggcttctacaagtcgagcaagaaaaatgacttcttctactggttcaactacaaaccaactgacaccgtagcggcctgccaagtcgcggccagtctgaagaacgctataggcgaggactggaagaccaagagcttcaaataccagacgataaacagcaacaaggagcaagtctcgaggacagtagactacaaggacctgtggcatctgctcaccgtcgcaaccagcgacgtgtacttgtacgaatttgcaatagataaattgggtctcgacgaaaagaacgccaaagcgttcagcaaaaccaaactcaagaaagattttgcaagcctttccctctcggccataaacaaaatcctaccgtaccttaaggaaggcctactatattcccacgctgtatttgtggctaacatcgagaacatagtcgacgagaacatttggaaagacgaaaaacagcgcgattacatcaaaacccagattagtgagatcattgaaaactacacccttgaaaagagcagattcgagatcatcaacggactcctcaaagaatacaagtccgaaaacgaagacgggaaacgagtctactattcaaaagaagcagaacagagttttgaaaacgatctcaaaaagaagctagtactcttctacaaatccaatgagatagaaaacaaggagcaacaagaaaccatcttcaacgaattgttaccaatcttcatacagcaactcaaagactacgagtttatcaaaatacaacggctggaccagaaggtactaatattcctcaaaggcaagaacgaaacaggacaaatattctgcacggaagaaaaaggcaccgcagaggagaaagagaagaagatcaaaaaccgcctcaagaaactataccacccctcagatatcgaaaagttcaaaaagaaaataatcaaagacgagtttggcaacgagaaaatcgtactaggaagccccctcaccccctcgattaaaaaccccatggccatgcgtgcactacaccaactacggaaagtcctcaacgcactcatacttgaaggacagatcgacgagaaaacaataatccatattgaaatggccagggagctcaatgacgctaacaaacgaaagggcatccaagactatcaaaacgacaacaagaagttcagggaagacgcaattaaggagataaagaaattatacttcgaagactgcaagaaagaagtagaaccaactgaagacgacatcctgaggtaccagctctggatggaacagaaccgctccgaaatctatgaggaggggaaaaacatctccatatgtgacatcatcggatccaaccctgcgtacgacatcgaacacacgataccacgctcccgctctcaggacaactcgcaaatgaacaagacgctttgcagccaaagattcaaccgggaagtgaaaaagcagtcaatgccaatagagctcaacaaccacttagaaatcctcccgaggatcgcacactggaaggaagaagcggacaacctcacccgagagatcgaaatcattagccgcagcatcaaagccgcggcaacgaaagaaatcaaagacaaaaagataaggcgcagacactacctcacactcaaacgagactacctgcaaggcaaatacgaccggttcatctgggaggagccgaaagtcggattcaagaactcacaaatacccgacaccgggatcataaccaaatacgcacaagcatatttaaaaagctactttaagaaagtagagagcgtgaaagggggcatggttgccgagttccgcaaaatctggggcatacaggagagcttcattgacgaaaacgggatgaagcattacaaagtaaaggatcgatcgaagcacacacaccacaccatcgacgcaataaccatagcatgcatgactaaagaaaagtacgacgtcctggcccacgcatggacacttgaagaccagcaaaacaagaaggaggcgcgctccataatcgaagccagcaaaccttggaagacgttcaaagaggacctcctaaaaattgaggaggaaattcttgtgagccactacacacccgacaacgtaaagaaacaagcaaagaaaatcgttcgagtgcgaggcaaaaagcagttcgttgccgaagtcgagagggatgttaacggcaaagcagtaccaaagaaagccgcttccggtaaaacaatctacaaactcgacggcgaaggaaagaaactgccccgcctccaacagggcgacaccattagaggctcgctccaccaagacagcatctatggtgctatcaagaaccccctcaacaccgacgaaataaaatacgtgataagaaaggaccttgaatccataaaagggtccgacgtagaatccatagttgatgaagtcgtgaaggagaagatcaaagaagcgattgcgaacaaagtgctcttactctccagcaacgcccagcagaaaaacaaactggtagggaccgtatggatgaacgaggagaaacgaatagcaatcaacaaagtccgcatttacgccaacagcgttaaaaacccgctacacatcaaggagcattcactcctaagcaagagcaagcacgtccacaaacaaaaggtgtacggccaaaacgacgagaactacgctatggcgatctacgaactcgatggcaaacgggacttcgaacttatcaacatcttcaatctcgcgaagctaataaagcaagggcagggcttctaccctctccacaaaaagaaggaaataaaaggcaaaatcgtattcgtaccgatcgaaaagaggaacaagagagacgtcgtcctaaaaagaggacaacaagtggtgttctacgacaaagaagtggagaatccaaaagacatctccgagatagtcgacttcaaagggcgcatctacatcatagaaggcctttcgatccagcgcatagtccgcccatccggcaaagtagacgaatatggcgtcataatgctccgatacttcaaggaagcccggaaagcggatgacatcaaacaggacaatttcaaacccgacggcgtcttcaaactaggggagaacaaacccacccgtaagatgaaccacaaccaatttacggcgtttgtagaaggcatcgacttcaaggtcctccccagcgggaaattcgagaaaatctga

SEQ ID NO: 6875 - RNA, 4425 nt, synthetic construct
  misc_feature 1..4425: note = Cas9 variant
  source 1..4425: mol_type = other RNA
atgaagaagatactcggactcgacctcggaacaaactccattggctgggctctaatcgaatcggacttcgaaaagaagcaggggaaaataaacggcctcggctcgcgcattatcccaatgtcccaggacatattaggcaagtttgattccggtgtctcgatttcgcaaactgccgaacgaaccagctatcgaggagtaagaaggctgaaccaacggaacctcctacgccgggaaagactacaccgcgtactgaatatcttggacttcctacccaaacactacagcaacgcaatcgacttcgagaaaaagctaggccagttcaaggagaacgtagaagaaaaactgaactacgccaaaaatcagataggccggcacgagttcatcttcatggattcattcaaggaaatggtgaaggagttcaagcaaactcagccccaactcttttacaagcgggaaaacggcattgagacaaaaataccctatgactggaccctctattaccttaggaagaaagcactctcacaaaagatcaagaaagaagaactagcctggatcattctgaactttaaccagaaacgaggctactaccaactccgcggcgaggacgtcctagacgagagcaagatcgaggacttctactcactcaaagtcgtggaagtccaagaaacggaagacaaaaacgcgcgggggacctggtataacgtgatccttgaaaacgactgggtctataaacgacagtccaaagagagcctggacaactggataggcaaaaacaaagagttcatcgtcaccaccaacaaagagaaagacggatcccttaagctcgacaaagccggtaatgtcaaacgcaacttccgcgctgtcgactccgaaaaagactggatagcgatcaagaagaaaacagagcaagacgtggagatctcaaaacataccgtaggacaatacatatacgaaaccctactacaaaacgccaaacagaaaatcaaggggaaactcgtaaagaccatagaacggaaattctacaaagaagagttcatcaaaatcataaaggaacagctcaaacaccatcccgaactgcaatctaaaaccctctacgaaacctgtatacaagagttgtacccacggaacgaagcccaccaaaataacattaagagcaaaggcttcgaataccttttcacggacgacataatcttctaccaacgtccgctcaaaagcaagaaaagcaccataagcggatgccaatacgagacccgactattcaagaaaacagtactaaacaaggtaacaaacaaagaaaacgagatctggcagaaggaaccactcaaggccataagcaagagtcacccgctgttccaggagttccgcctctggcaattcctgaaaaacctcaaaatatatcaaaaagaagacgtcaaaggcaacctcatcgaccacgacattacgtccgacctcctcaagacagaagcagactgggtcgaacttttcgactttctaaatatcaagaaagagatagaacaaaaacagataatacagttctttatcaacaacaaacaaatagaaaaaggcaagaaaaacaactaccgctggaactacgtcgaggacaagaaatacccctgcaacgagacaaaatcccaactaattagccgtctaaagaaagtcaaaaacctagacctcaaccttttcttcacgagtgaaacagaactcaaactatggcacatcatctacagcgtcaaagacaaaatacaatacgagaaagccatcaaaaacttcgcaatcaaaaacaatatagacatagacagctttgtagaaaacttcaaacgtttccctcctttcaaaaacgaatacgcggcctacagcgaaaaagccatcaaaaggctcctcccgctcatgcgcatgggcgagtactggaacgaaagcgagatcaagcaagaggtcaaggaccgtgcctactccataatagaaagacttaagggaatagacttcaacaaagacaagatagacgagaaaataaccgacgacgacattaagaagcaactactcaagagcttcatagatttcaaagacaagaatcccctaaagggcctcaacacgtaccaagcctgctatctcgtctacaaccggcactccgaagtaaacagcatcgcttactggaaaagcccagacgacataaacaaatatctcgaaggcttcaaacaacacagtctccgcaacccgatcgtcgaacaagtagtgacagaaaccctgcgaaccgtcagagacatatggcagtactacggtaaaggaaaagcgagtttctttaacgaaatccacgtcgagctaggccgggaaatgaagaacccagcgtacaaacggaaagcatctacgaaccgcgtgacggaaaacgagaacacaaaccacaggataaaggagatcctcaaggaactgcaaaacgagggcgtacaggaggtcaagagctactcacgcaaccaacaggagatcctcaaaatctacgaggagggtatctaccaaagcatagacgtagttgacgacgccatagagaaaataaggaagaactccagcccaaccaaagccgaaatcatcaaatacaagctctggctcgaacaggggtacacgtcaccatacaccgggaaaacaatcccaatgagcaaactattcaccaccgactaccaaattgaacacattatcccgcaatccctctacttcgataattcactgtcgaacaaaatcatatgcgaatcagaggtgaaccaacttaaggataaccagactgcctacgagttcattaaaaagcacggcacggaaaaggtgagtctaggcaaaaacaagacagtcgaaatcttcactctcgaacaatatgaaaaacactgcaaccaatactttaagaaaaacaaaaacaaactcaagaaactcctcagtgaagaaatacctgaaggatttatcaatagacaactcaacgattcacggtacatatcgaaattcataaaaggcctactaggaaacctcgtacgggaagaagacgaacaagaagttacaacaaagcacatcgtcccagtcacaggagccatcacaagcaaactgaagcaggactggggcctcaacgacaaatggaacgaactcgtcgccagtcgcttccagagactaaacaccatgaccaactctaacaacttcggatactgggacacgaaaatcaatgcgttccgagtccaagtacctgatgaaatcagcaagggattcagcaagaaaaggatcgaccatcgccaccacgcactcgacgccctcgtgattgcgtgctgcacccgcaaccacatcaattacctcaacgcgctcaatgccgaaaagaaaaattacggcttacgcgacctcctactcataaagaacgacaaaaaccactacacaaaattcttcaagcacccatgggacggattccccgtggaagcaaaatccgtactagagaaaacgataatcagcttcaaacaaaacacgcgagttataaataaaacaaataataaaacgtggcagtgggctgaaaaagaagggcagctaaagaaggtgctagtgaagcagacaaaaggagacaactgggccatacgtaaacctatgcacaaggaaacagtctccgggaagctcaacatacccacacccaaaggcaaaatcgcaaccgcctcccgagtctctctgagcgaaatcaaaacccgaaaacagctagacaagataaccgatatctccatccaaaagatcctggaacgccacctaaataattacctcgacgacaaaggcaaagagaagtttgaccttgcgttcaacgcagacggggtcgaagaactcaacaaaaacatcaaggtcctaaacaagggcaaaaaccatcaaccgatctacaaggttcgtctatatgagatcggctcccgattcaaagtcggcaacagcggaaataaaaaggacaagtacgtcgaagcggcgaagggcacaaatctattcttcgccatatacctaaatgagaaagacaaaaagcgcgtctacgaaaccatccccctgaacgaagtcatcgaacaccaaaaacaggttagtaacctaccgaagaatgagcgaaccccggtaccggttaaccatacaaagggaaaattcctcttcagcctctcaccaaatgacctcgtatacgtacccaccgacgaagaaatagacaacccctccctagtgaacttcaacaaccttaacaagaagcaagtagagaaaatctacaagaccgtctcatgctccacctaccaatgcttctttgtccacaacaccataagcaaacccatacagaacaaagtcgagttctccgcactcaataaaatggaaaaatcgattgacggcatcatgataaaggacaggtgctggaaactaaaaatggaccgccttgggaacattatatccgtcatcaggtga

SEQ ID NO: 6876 - RNA, 4443 nt, synthetic construct
  misc_feature 1..4443: note = Cas9 variant
  source 1..4443: mol_type = other RNA
atgaaaacaattctgggcctggacctagggaccaactctataggctgggccaaagtgtgcgtcgacaacgatggaaactacctaagggacataaaactcgggtcgcgaattatcccgatgagccaggacaccctgggcaacttcgacaaaggagtcactgactcaccaacagccgcacgtacgggctttcggggcgtaaggcggatccgcgaacgcgcgctgcaacgccgcgagagactccaccgcgtgctacacgtcatgaaattcctgcccccgcactatgagaacgccatcggttggaacagagaggaagccacaacctacggcaaattcttaaaccacggggaacccaaattagcctgggagaaacaagaagatggctcgatgcgattcctattcatggactcttttcacgagatgatggcggacttcgccgaatcgcagccggggctagtcgctggcggaaagaaaatccccctcgactggaccctctactacctgcgaaagaaagccctcacgcaagccatccgtaaggaagaactcgcatggatactcctcaacttcaaccaaaagcgaggctactaccaactccgcggggaggaggatgaggaaaacccagcaaaaagagaagagtatcacgaactaaaggtagtaagcgtcgaagcagccgaagaaggaaagggagggaacacatggtacaatgtaaccctagaaaacgggtggatataccgaaggcaaagcaaggtggagctgcacgactgggtggggaaaacccgccaattcattgtaacgaccgagtacgagaaagacggagtaacgatcaaaaaggacaaaaacggggaagtcaaaagatcattccgggccccatcagaggacgactgggggcttcgcaagaagcgcaccgaaagcctgctcgaagacagcggcaagacagttggggcattcatctatgaccacatactaagcgagcctacggacaaaatacgcggcaatttcatccgcaccatcgaacgcaaatactacaagaaagagctcgaggcgatattactcgaacaaacaaaacaccataaagaactaaaggaccaaaacaccctcatcgcgtgcatcaaggaactgtaccaaagcaataagccacaccaagattcactaatgaagaaggacatgacctacctattgatcacagaccttatcttctaccaacgccccctcaagtcgaaaaagtcactcatcgccgactgcccctacgaatattacgaatataccatcaaagagacaggagaaataaaaagacagggaatcaagtgcatagcaaaatcaaacccctactaccaagagttcaggctgtggcaattcatcataaacctgcgactcttcgatagaaccgatgacaaagaagtaactagcgaatacctatcgagtatggaagactacaccaaactcttcacctacctgaacgaccgaaaggacatcaaccaggaaactctccttaaggacttcttcaagcaaaagaaagtaaagatgggaatggaaaaagagttccccatccgctggaactacatcgaagacaaggaaaagaaatatccgtgcaacgaaacccgccacgagttgctcgccgctctagataaagccgggatcgaccactcgtggctcgatgacaaagagcgattctaccgattatggcacctactatattcagtggagagtaaggaggaagccgaaggcgccctccgcaagctcaaagacaacgacgactttgtgaacgccttcctcaaagtgaaacccttcaagaaagactatggcgcgtacagcgagaaagcagtcaagaaactcctggcgattatgcgcatgggcggactctggaacgaaacggacatatgcgaacaaacaagaaacagaatccagtctatcataaaaggagagatcgacgagaaaataaaagaacggatgggcagaaccttctgccaattaagtgacttccagggcctccccgaatggctagcctgttatgttgtttacggccggcacagcgaagcgaccgacatccaacgctggacaaagccggaaaacctcatggcatatataaacggattcaaacaacacagcctccgaaaccctatagtagagcaatgcatcctggaaacgctccgcaccgtgcacgacatatggaaggaagccggccacatagacgagatccacgtagagctcggaagaagcatgaagtcaactgccgaccagagggcgagaatgagcaaaagcatcctgcaaaatgaaaacacgaaccttcgcatcaagagccttctaatggagctcaaaaacgcgaaagaaatcgagaacgtaagaccatacagccctatgcaacaagagatattacgtatatatgaggaaggcgccctgcaagagttaaccaaagaagacgcacagtacccagagatcagcaaaatctcacaaatggcacaaccatcggccaaggaactactcaagtaccgcctatggctagaacaaaagtactgcagtccgtacaccggaaagccaatatcgctgagcaaactcttcaccagcgcgtatcagatcgaacacatcataccgcagagccgctacttcgacgactccttcacaaacaaggtaatctgcgagacggaagtcaaccaacttaagtccaatatgctaggatacgagttcatcaaaaagcattctggagaaatagttcactgcacgacaataggcgacgtaaaaatcctcgacgctaaagagtactacaacttcgtcacggaacactacgcaaacaaccgccgcaaaaaggaaaaacttctcctggaggacataccccaggagttcctaaatcgacagatgaacgacagtcgctacatttcgaaaaaggttatggccatcctgagcaatatagtccgggaagaagacgaacaagagaccaacagcaagttcgtagtcagctgctccggagggataaccgaccggctaaaacaagactggggactgaatgatgtctggaacagcattgtttacccgcgattcgaaagactaaacaagttgacccaaaccgaggcatttggaaggtgggaaaataaagagggaaaacaagtcttccaaacctcgcttccactcgaactccaacgagggttcagcaagaaacggatagaccaccgccaccacgccatggacgcgctagttatcgcatgcgcaagcagaaacattatcaactacctcaacaatgaatcagcgaaatcacaagaacaacgtgaggacctacgcaagaaactctgcgacaaaaacagaatcatccgcaaaccctgggaaacgttcacgcaagacgcgcggactgcactagaagacgtcgttgtctcattcaaaaactacgtccgcgtaataaacaaagcgaccaattactatgagaagtacgacgagagcggtaaaaagggaatggccgaacaaaagggacaggacatgtgggccatccgcaagccgatgcacaaagaaacagttttcgggcaagtaaacctccgccgaaaggtaacagtcaagctgaaggacgccctagaaaacatcccagcaatctgcgacaaagcactccgggactacgtaaacgacctcatcgcaaagaagttcaacacgaaacaaatgctagcacacttcaaaagcatcaactatcgactgaacatgaaaagcgtaaacaaagtcgggatatgggtcttcagcgacgaaaaagagcctatggtcgcaaccaggaaagcaattgatatatccttcgacgcgaaacgtatcgacactatcaccgataccggaatccaacagatactatgcaaatacctaaaaagcaaagggaacgacccgaacgtggcattcaccccggagggaatagccgagatgaacaaacatatcattgactacaacaacggcaaacaacaccaaccgatactaaaagtacgtgtatccgaacccaagggagcgaagtaccaagtgggagaaaccggcaataaaaccaagaaattcgtagaagcccagaaagggaccaatctctacttcgccatctacgaagacaaagacggcaatcggagctacaacaccataccattgaatgaagtggcagagagactgaaacaaggcctgagccccgtgccagagaagaacgaaaaaggcatcagcctcaaattctacctaagcccaaacgacctcgtctacgtgccaaccgaagaggagaaactctccaacgaatgcaaactctccaaggagcggatctacaagatggtatccagcacctccaacgagtgtcacttcataccatacaccacggccaagcccatctacgacaagtttgaatacgaagcgaagaacaagatgggacgcgctctaacaggcgaaatgataaaggctgtgtgctggaagctggaagtagacagactgggaaatatactcaagatcatcaaatga

SEQ ID NO: 6877 - RNA, 4452 nt, synthetic construct
  misc_feature 1..4452: note = Cas9 variant
  source 1..4452: mol_type = other RNA
atgaaaacgatattaggattagacctgggcaccaacagcatcgggtgggccaagatatcaatcgacgacaatggtaactaccttagagatatccaaatgggtagtcggattatacccatgtcccaagacgtgctgggcaacttcgactccggcgttaccgagtcccaaaccgcagtccgcaccggattccgcggcctccgcagaatcagggaacgctcactcctccgcagagagcgactacaccgggtactgcacgtgatgggattcctaccaccccactacgactctgctattggctggaacaaagaggaacccacaacgtacggcaaatttttaaaccatggcgaaccaaagctggcctgggaacgacaaggagacggatcaatgcgcttcctatttatggacagcttccacaaaatgatggaggacttcgcgccacaccaacccgcactcgtggccgacggccggaaaataccgctcgattggaccctatactacctccgaaagaaagcactcacacaaccaatcaaaaaggaggaactagcatggatcctactaaacttcaaccagaaacgcggttactaccagctacgaggagaagaggaggaagaaaacccgacaaaacgcgaagaataccacgaactcaaagtagtcagcgttgaggccgcggaagaagggaaaggaggaaacacatggtacaatgtcaaacttgagaacggatggatctacagacgctccagcaaaatacccctggacgactgggtgggaaaaacacggcccttcatcgtaacgacagaatacgaagcagacgggataaccctgaaaaagaacaaagaaggagaagtcaaacgatccttccgggcccccggagaagacgactggggactacgaaagaaacggaccgagtcacaactagaggctagcgggaaaaccgtgggcgcctttatttacgaccacttacttgcagaacctgcggataaaataagaggcaacttcattcgcaccatagagcgcaaatactacaaacaggaactcgcagacatactgcgcgaacaatccaaataccacgaggaactccaatccaagaaaatactcgccgactgcgccgaggagctctaccgctcgaaccagccgcaccgagactcgctcctgaagaaagacatggtgtacctcttactcacagacattatcttctaccagagacccctcaaaagtaagaaatcattaatagccgactgtccatacgagtactacgagtacgtcgacaaggagaccggcgagatcaaacgtcagggaatcaagtgcgtcgccaaatccaacccgtactaccaagaatttagactgtggcaatttgtattaaacctcagactgtacgacagaaccgaagacaaagaggtgacagccgaataccttccaagcaaagaagattacgcgcggttgttcgtgtacctaaacgaccgcaaagaaataaaccaagagaccctgctaaaagacttcttcaaactgaagaaggtcaaacaacggagcgaaaaggagttcccagtccggtggaattacatcgaagacaaggaaaagaagtacccctgcaacgaaacccgacacgaactcctaatggcactagatcgcgcaggcatagaacgtagctggctagacgacaccgcccgacaatgcagactctggcaccttttgtacagcatcgaggtcaaagacgaagcggaaagagcactacggaaactcaaagacgacgatgagttcgtcagcgccttcctcaaggtaaaacccttcaagaaagactacggcgcctactccgaaaaagcagtaaagaaactcctcgcagtaatgagaatgggatcgcactggtgcgaagacgacatatgtaaagagaccaaagagcgcatcgaacacatcctacaaggcgacgtcgaggagaaaatcaaagaacgcatgaaccacaccgcgtatagtctgggcgaactgtctgacttccaagccctaccggaatggctcgcatgctacgtcgtgtacgggcgccactcagaagcaacggacatcaaacactggaaaaccccggagtcgctcatggcgtacattaacggttttaaacagcactccctcagaaacccaatcgtcgaacagtgcatactcgagacactccggaccgtccatgacatatggaaagaggcaggccacatcgacgaaatccacgtagaactggggagaagcatgaaaagcacgtcggaccaacgagcacggatgaccgaaaacatactacgcaatgaaaacacaaacctacgcataaagtccctccttatggaactaaagaacgacgcagacatcaaggacgtccgaccctacagtccgatgcaacaggagatactcagaatctacgaagagggggcgctccaagagctcaccaaagaagacaacgactatgaagagatatttaaaatatcgaagatgccccagccctcagccaaagagctgctaaaatacaaactgtggctcgagcaaaaataccgttcgccctacaccggaaaaccgatatccctcagcaagctattcacgagcgcttaccagatagagcacatcataccacaatctcggtacttcgacgactcattcaataacaaggtaatctgcgaatccgaagtaaacgcccttaaaggaaacatgctaggctacgagttcatcaaaaaccacggaggcgaaatagttcactgcacactcctcggtgacgtaaaagtgcaaaatgaatcggaatacaaggcatttgtaacggaacactacgcaaacaacaaatacaaaaaggaaaagctgctgatggaagacataccacaagacttcttaaaccgccacctcaatgacagcaggtacatctcaaaagtcgtaaaaacgctcctctctaacatcgtgaggacagaagacgaaatggaaaccacaagcaaattcgtagtatcgtgcacgggtggaatcaccgaccgtctgaagaaagactggggcctcaacgacgtctggaacagtatcgtctacagccgcttcgagcgactcaacgagctaaccaaatctgacgccttcgggcgatgggagaacaaagagggcaaaagagtcttccagacatcagtaccactggaactccagcgtggcttcaacaagaagcgaattgaccacagacaccacgcgatggacgcgctcgtcattgcctgcgccagcaggaatatcatcaactacttaaacaacgaaagcgcaaattccccaaagaaacgcgaagacctcagacaacaactatgcgataaaaaccgtataatccgaaaaccatgggaatcctttacccaagacgcacgtgccgcgctcgaagacgtagtcgtgtccttcaaaaattacgtacgcgttatcaacaaagcaacaaactactacgagcgctacgatgccgacgggaagaaaaccatcacaaaacaaaagagccgcgaaatgtgggccgtacggaaacccatgcacaaagaaacagtcttcggccacgtcaacctaaggcggaaagcgatcgtcaagctcaaagacgccctggaaaacatacccagcatttgcaataaggagctcagggactatatcaatgggctcgtggaacgcaacttcaacaccaaacaactacatgcccacttcagaagcaccgactaccgatggaacaaacaaaacgtagacaaagtagaggtatggcggttttctgacgaaaaagaaccactcgtcgcaacccggaaaccgctggacacatccttcgacgccaagcgaatcgacacgataaccgacacaggcatacagaaaattctcctcaactatctagaggcaaagggtggggacccccttattgccttcacgccagaaggaatagcagaaatgaaccaaaacatcgctctctacaacgatggtaaaatgcaccagccgattctcaaggtgcgaatcagcgaacccaaaggcgcaaagtaccaaataggacaaaccggcaacaaagccgacaaattcgtagaggcccagaaaggcacaaacctgtacttcgcgatctatgaagacgaagaccgcaaccgcacatacaacaccataccgctcaatgaggtcgccgaacgcctcaaacagggactaccaccagttcctgagaaaaacgaaaaagaagtaccactaaaattctacctctcgccaaacgacctagtctatgtcccaacggaagaggaaatactaatgaaagaatgcaaactcaacaagaaccggatctacaagatggtatcctcgacggggaaccaatgctttttcattccgttccgggtcgccgtctccatagtcaacaaaatggagtacagtcccctaaacaaaatggaaaaggcaatctcctcggagatgataaaagcagtctgttggaaactagaagtggaccgactagggaacatcatacgggtcgtaaagtga

SEQ ID NO: 6878 - RNA, 4452 nt, synthetic construct
  misc_feature 1..4452: note = Cas9 variant
  source 1..4452: mol_type = other RNA
atgaaaacgatactcggcctggatttaggcaccaacagcataggatgggctaaggtctctcttgacgacaacggaaactatctccacgacatcaaactaggatgccgaataatcccaatgagtcaggacgtactcgataacttcggaaaaggcgtaacggtttcccaaacgtctgtccgaacaggcttccgaggagtgcggaggatcagagagcgcagccttcagcgccgggaaagactacaccgcgtcctgcacagactcggcttcctacctcagcactatgacgctgcaataggctgggacagcgactgcgccaaaacgtacgggaaattcttggacaatggcgagccgaaactggcatgggaaagacaagaagatggatcaatgagattcctgttcatgaatagcttttacgagatgatagcggacttcacgtcccatcagccagccctagtagccgacggcaaaaagatccccctcgactggactctctattacctccgcaagaaggccttgacccaagcaatacggaaagaggaactggcatggatattgctcagcttcaaccagaaaaggggatactaccaactaaggggagaagaggaagacgaaaatcccaccaagcgagaagagttctgcgagctaaaagtggtcgccgtagaggctgcggagaagggaaaaggagacgacatctggtacaacgtccacttagaaaacggttgcatctaccggcgatcctcaaaaatctcgttagatgactgggtaggcaagacaaaacaattcataatcaccactgaatacgagaaagacggagtcacccccaagaaagacaaagacgggaaagagaaacgcagttaccgagcccccaaagaggatgactgggggctacgaaagaagcggaccgaaactgatctcgaggctagcggcaaaacagtaggcgccttcatatacgagcatctcctcgcagaacccttcgacaaaatccgcggcaattttatacacaccatagagaggaagtactaccgtgcagaactagaggctatcctcactgagcaacgcaaataccacgaggaactacggtcggaacaaatgctggccgtctgcgccgaggagctataccgcagcaacctaccgcaccagcaatccttgcttaaaaaggacatggtctacctactgctttccgacctaatcttctaccaacgtccccttaagtcgaagaaatcactaatagccgactgcccgtatgaatactaccgatacgtcgacaaagagacaggagaaatcaagaaacaaggtatcaaatgcatcgctaaaagcaatccctactaccaggaatttcggctatggcaattcgtcctcaacctacgcctattcgacaggatgaccgacaaagaagtaacagcagactacctccccaccaaagaggactacgtgagactattcgactacctcaacaaccgcaaagaaattaaccaggagacgctactaaaagacttcttccgactgaagaaagtcaaactcggacgcgaaaaagagttcgaaatccgatggaactacattgaagacaaggagaaaaagtacccgtgcaacgaaacgcgatacgaactcctcgtagccctagaccgggccggtatcgaccgatcgtggatagatgaagacggtcgacagtaccgtctatggcatttgctctactccattgaagtaaaggccgaagcagaatcagcactcagaaaactaaatagcgacgacgcgttcgtctcatcctttctaaaggttaaaccattcaagaaagactacggggcatacagcgaaaaagcagtcaaaaagctcctcgcggtaatgcgcatgggatcaatgtggtcggaagcaaacatctgcgaagaaacgcaaaacagaatccgatccataatcagaggagacatcgaggagaaaataaaagagcgaatgggacacaccgcacgcagcttcaaccaaatcgacgacttccaagcgctccccgaatggctcgcatgctacgtagtctacggacgacactccgaagtcacagatatacaacattgggaaacacctgagcaactacaatcctacatcaatggattcaaacagcacagcctgcgaaacccaatagtcgaacaatgcatcctcgagaccctcaggaccgtccacgacatttggaaagaagcaggccacatcgacgaaatacacgttgagctaggcagagacatgaaacgaaccgccgaccaacgcgcgcgcatgaccaaaaacatactcaaaaacgaaaacacaaacctccgtataaagtcgctcctgatggaactaaagaaagacaccgacatcaaagaggttcgaccctactcacccatgcagcaggagatactacgcatctacgaagagggcgcactcttgcaactaaaaagagacgacgaggctttcgccgacataagcaaaatctcccaaatggcccaacccacagccaccgaactgcgtcgctacaagctctggctcgaccaaaaatacaggagcccttacacaggaaaattcatttcactctccaagctattcacctccgcgtaccaaatcgaacacgtcatcccacaaagccgctacttcgacgacagcttctccaacaaggtgatctgcgaggcagaagtcaaccgcctaaaatcaaacatgctcggttacgagttcataaaggcccacggaggagaaatagtacactgcactatgctcggtgacgtaaagatcctgtcggaaagcgaatataaggccttcgtcaacgaacactacgtgaaccaccgcgcaaagaaagaaaaactgctaatggaggatataccgcaagagttcctaaaccgccaaatgaacgacagccgatacatcagcaaagtagtcaaggcgcttctgagtaacatcgtccggacagaagacgaaatggacgtcaccagtaagtttgtcgtaccatgctccggaggaataaccgaccgattaaagaaagactggggcctaaacgacgtctggaactccatcgtgtacccaaggttcgaacgactaaatcgcatgaccggaacggaagccttcggacactgggaaaataaagagggcaaacgcgtattccaaacctcagtgcccatagagctccaactaggcttctcgaagaaacgaatcgaccacagacatcacgccatggacgccctagtcatcgcatgtgcctccagaaacatcatcaactaccttaacaacgagagcgccaacagccagaagaaacgcgaggacctaagacgcctgctgtgcgacaaaaaccgcataataagaaagccctgggagagcttcacacaggatgcccgcgtcgccctgcaagacatcgtagtgtccttcaaaaactacgtgcggatcatcaacaaagcaacaaactactacgagcgctacgacgaacagggcaagaaaacgacggcagagcaaaagtcctcagaaatgtgggctataaggaaaccgatgcacaaggagacagtcttcggacatgtaaacctaaagcggaaaacaaccgtcaaactcaaaaatgcaatagaaaatatcccgaacatttgtaacaaagaactgaaggcttacataaacgaactcgtcgagaaacactttaacaccaaacagatgctagcccacttcaagtcaatcaactaccgatggaacagacaaaacgtggagaaagtggaggtctggcagtactccgacgaaaaggagcgaatggccgccacgcgtaaaccgctcgacaccagcttcgacaagaaaagaatcgaaacaatcacggatacgggaatccagaaaatcctcctgaactacctggaagagaaaggtggcgacccaaacatcgccttcacgccggaaggaatagcagaaatgaacaaaaacatctcactcttcaacgacggcaaactacaccaaccgatactcaaagtcagagtcgccaaaacgatgggcgccaagtaccaagttggccaaacagggaacaaggccgccaagtacgtaggagctcaggaaggaacaaacctgtatttcgctatatacgagaacgaagagggggaacgcagctacaatgcggtgccactcaacgaggtagcggaaagactcaaacaagggatgtcccctgtaccagagaaaaacgaaaaagacgtcccgttgaagttttacctcagccccaacgacctagtgtacgtgccaaccgaagaagacaaactcagcaacgaatgcaagttagacaacgagcgaatatacaaaatggtctccgccaccgggaagaagtgccacttcctaccatacagcgtcgcaaacataatatacaacaaagtagagttcgaaagtatgaacaagatgggaaaggccctgagcggggaaatgattaaagccgtctgctggaaactggaagtagatcgcctaggaaccattctgcgcgtgatcaagtga

SEQ ID NO: 6879 - RNA, 4452 nt, synthetic construct
  misc_feature 1..4452: note = Cas9 variant
  source 1..4452: mol_type = other RNA
atgaaaaccgagctcgacctcaacaaagaccgcctatacaaacacgtcctgggcctcgacctaggagtcacctcaatcggattcgcacacgtagtcgaatccgagaaccgcaacgagagcgagataaaacagataggcgtgagagtgatccaactcgataacttcgacaaagtcgacaaaagcggaaagacctccgagtccaaaaaccccgcagtggactttgcggccggcaaaggactaacccccaacggatcaagaacgaagaaaagaggggcgcggcggaatctggacagataccaagaccggcgagacaacctgttggaggtactaaccaagtcggggtttatcaattccgagacaaagcgcaccgaagacgggaaacacacaacgcaccagacctgggaaatacgagccaaggccgtatcagagaaagtagagaaagaggaatttgcccgcatactcctagccataaacaagaaaagaggctacaaatcaagccggaaggctaagaatgaagacgagggccaggccgtggacgggatggcggtagccaagcgcttatacgaggagaatctcaccccagggcaatatgcgtacgaggttctgtccgggggcaagaaaagcatcccggatttctaccgatcggacttgcaagcggagttcgacaaaatctggaatttccaaaaacaattctacccaaacatcctaacagacgagttctacgaagaactgaaaggaaaggggcaaagggcgacctcggcagccttctggaagatccaccaatttaacacagccgatataaaagacctagaggacgaactcaaaaacgagcgcacaatcaaactgtccaaacgcgatcagaaaaagttgcaagcctataaatggcgctccgaagcggtggtcaaacaactaggcaaggaagaggtcgcctacgtattgaccgagataaacaacaatctcaacaattcatcaggatacctaggcgccatctcggaccgcagcaaggagctctatttcaataagcaaacggtaggccagttcctgtacaagcaactcaaggaaaacccacacaccagacttaagaaccaagtattctaccggcaagactaccttgatgagttcgaaacgatctgggaaatgcaagcccagttccaccccgaactcacgcaggagctcaaagaagagattagagacatcataatcttttaccaacggaagctcaaatctcaaaaaggccttatcagcttttgcgaactcgaatcaaaagaagttgtgatcaacgacacaaagaaaataataggcctccgcgtagcccccaaaagctcgccactatttcaagagttcaaaatttggcagaacctcaacaacgttctcgtccgtaaaaagggatcaaggaagcgcatggtaaaagcccaaaaccagcacagcctcttcgaggaaccgaaagaaatatttagtctcgacctcgccagcaaggaaaaactcttcgaggaactgaacctaaaaggaaatctatcggctaaaaactgcctagacatactcggcctaaactccaacgaatgggaactgaactacacccaactggaggggaatcggactaacaaatcactctatgaggcattcctgaaaatactagacatcgaaggatacgacgtaaaagacttgcttaaggtaaaaagtagcaaagacgaagtcgagctggacgacctcaaggtaccggcaagcgaaatcaaaaacatggtaagagaaatattcagcaccaacaagatcgatacagaaattcttgacttcgacgccgaaatcgatggaaaggccttcgagaaacaaagcagctaccagctatggcacctactctacagttacgaaggcgacgactcacagtcaggaaacgagaagctgtacgaattgctcgcgaagaaattcggcttcaaacgggaacacgcccaaattctggcaaatgtgagcctggtcgacgactacggcaacctcagttcaaaggcaatgcggaagatttatccgcacatccgcgaaaataactactccaccgcctgcgagctcgtaggataccgccacagcaaacacagcctaaccaaagacgaactcaaagaccgtgttctcgaagaccgtctcgaactgctaaagaaaaactccctccgacaaccagtcgttgagaaaatactaaaccaaatgatcaacgcggtaaacgctctgatcgagaaaaactccgaacgagacgaaaacggaaacataaccaagtacttcaagttcgatgaaataagaatcgaactagccagagagctcaaaaagaacgccgcagaacgagcagaaatgacgacaaatatcaacgcagccaagctagtccacgagaaaatattcaaaatcctccaaaacgagtttgggatcaaaaatcccacacgaaacgacatcatccgatatcgcctctacgaagaactcaaaggcaacggctataaagacctctactcaaacacatacatcccccgggaaatcctcttcagcaaccaaatagacatagaccacatcctcccgcagtctcggctgtttgacgactcattctcgaacaaagtcgttgtctttcggaaagacaacctcaagaaagggaaccaaacggcgatagactatataggatccgaagtcggcgaggagggcctgaaaaactttatcgaacgcgtggaaagcctatacgagcttggcaaaaagaataaagaagaaggaatatcgaaagcgaagtaccagaaactcttaaagagcgcatcggaaatcggagatggattcatagaacgggacctccgcgagtcccaatacatagctaagaaagcaaaagaattactattcaaggttaccagatccgtcgtatccacctccgggagcatcacggacagactcagagaggactggggactgatcaacgtcatgaaagaactcaacctgccaaagtacaaatcactaggacttacagaaatccaagaaagacgcaacggacaccaggtcgaagtcatcaaagactggaccaagcggaacgatcacagacaccacgccatggacgcactggctgtggcattcacgaagcacaaccatatacagtacctaaactatctaaacgcacggaagaacgagtcgcacaagctgcacggcaacataatcgcgattgagacgctggaaacagaagtaaaaatcgacgaccttggcaataagaaacgagtgttcaaagaacccataccgaacttccgccaggtcgccaaagaacacctcgagaatgtactcatatcacacaaagccaaaaacaaagtcgttaccaaaaacaagaacaaaatctccggcaaagagaaacttcaaataacactgacaccccgagggcagctccataaggagaccgtatacgggaaatacaggttctaccagtccaaagacgaaaaagtgagcgcaaaatttgaccttgaaaccatcgaaaaagtcgctaacccgtcgtacaaggcggccctgctacagcgcctaaacgaaaacgaaaacgacccgaagaaagcattctctggaaagaacgcactcagcaagaatcccatatatatcagcatggaaaacgacataaaggtcccagacaccgtcaagctcgtatggctcgaagaagactattcgataaggaaagatgtaacacccgagaacttcaaagacgaaaaatcaattgagaagatcctggacgaaggggttaaacgaatattaaagaaccgactaaaagagttcggcggcgacgcgaaagaagccttctccgacttagacaagaatcccatatggctaaacgaagaaaagggcacctccataaaaagggttcgcatatccggcgtcaaaaacgccgagccacttcactacaagaaggaccactttgggaacgatatactggacggcaatggcaacaaaatccccgcggacttcgtctcgacaggaaataaccaccatgtcgcaatttacaaggaacccgagttcgacaagaaaggacagccggtcctcgacgaactagggaatcagaaatacaaccttcaggaaaaagtggttagcttcttcgaagccgtggaacgagtaaatcaggggctgccaatcatagacaaaacgtacaatcagcacctcggctggcagtttttcttcaccatgaaacaaaacgaaatgttcgtctttccaaacgaaaagacgagattcaacccgatcgagatcgacttactagatccgaataacaagaaactgatctcgctaaacctctttcgagtccaaaagatagccaacaaaaactacatgtttcgccatcacttggagacgaacgtcgacgacaagaaagaaatgaaaaacatcgcatttatacacatacagagctgcaacctcctgaaagaaatcataaaagtccgcctgaaccacctcggagacatagtcagcgtcggagagtactga

SEQ ID NO: 6880 - RNA, 4452 nt, synthetic construct
  misc_feature 1..4452: note = Cas9 variant
  source 1..4452: mol_type = other RNA
atgaaaacgatactgggtctagaccttggcaccaacagcatcggctgggccaaagtctcagtcgacgaccacggcaactacctccatgacatcaaactaggaagcagaatcataccaatgtcccaagacatccttggcaacttcgacaagggggtcactgaaagccaaaccgctatccgcacaggcttccgttcagtaagaagaatcagggaacgaagtctcctacgcagagaacggctccaccgcgtgctgcacgtcatgggcttcctacccccgcactacgacagcgcgatcgggtggaatcgcgaggaagcgagcacgtacgggaagttcctgaaccacggagagccaaaattagcctgggagcgcctcgaagacggaagcatgcggttcctgttcatggactccttccacgagatgatggccaacttcgcccgccaccaacccgccctcgttgccgacggaagaaagataccccttgactggacgctgtactacctccgcaagaaagcgctctcacaagcagtagggaaagaagaactagcctggatattgctcaacttcaaccagaaaagaggttactgtcaactcagaggggaagaagaagaggagaccccaaccaaacgggaagaatattacgaactcaaggtggtaagcgtcgaagccgcagaagagggaaaaggaggcaacacctggtatcgagtccaactcgaaaacggctggatataccgacggcccagcaaaatagccctggacgactgggtcggaaaaacaaaacagttcattgtaaccaccgagtacgagaaggacggcacgaccctcaagaaagataaagacggggaggtgaaaaggtccttccgcgccccaggagagaacgactgggggctccgcaagaaacgcacagaatcccaactggaagctagcgggaaaacagtaggcgcgttcatatacgaccacctactggcggaaccggccgacaaaatacggggcaattttatacgaacaatagagcgcaaatactataagcaggagctggaggcaatcctccgggaacaaaccaaacaccacgaggaactacgttcaaaagaaatgcttgcaaaatgcgcagaggaactgtaccagtccaatcaaccccaccgaaaatcactcctcaacaaagacatgacgtacctcctactaacagacctcatcttttatcaacgaccactgaaatcaaagaaaagcctcatagcggagtgcccatacgaatactacaaatacaaggacaaggaaaaggggaaaaagaaacggcagggaatcaaatgcgtcgcgaaatcaaacccatactaccaagagtttcgcctctggcaattcatcgtaaatctccggttgttcgaccgcaccgacgacaaggaagtcacagccgagtacctgcgcagccgggaagactatgcgagactcttcgcgtatctaaacgaccgcaaagaaatcaaccaagaaacgctcctcaaagacttcttcggcctcaagaaagtaaaaataggagccgaaaaagaatttgcaatccggtggaactacatagaagacaaagagaagaaatacccatgtaacgaaaccagacacgaactactactcgcgctcgaccgagccgggatggaccgatcttggctcgacgatagtgaactccagtacagactatggcatctgctctactccgtcgaagcacgggacgaagcagaaggagcactgcgcaaactacgggatgacgacgagttcgtcggagcattcctaaaagtaaaaccgttcaaaaaggattacggcgcatactccgaaaaagccgtgaagaagctgctcgcggtaatgcgaatgggatcctggtggcacgaagaagacatatgcaaacagactcgtgaccgcattgaaaggatcgtacagggggacatagaagagaaaatccgcgaaagaatgggacacgcggcgtactcgttcagtagactggcggacttccaagggctaccggaatggttggcgtgctacgtcgtgtacggacgccactcggaagcgacgcacattctaagatgggacagccccgacaagctactgagctacataaaaggattccgacagcactccctacgaaaccccatagtcgaacaatgcatcctagagacactacggacagtacacgacatatggaaagaagccgggcacatcgacgaaatccacgtcgagctggggagaagcatgaagtcgaccgctgaacaacgcgctcacatgacgaaaaacatactccgcaatgaaaataccaacctacgaatcaaatgcttacttatggagctcaagaacgacgccgacgtaaaggatgtccggccatacagcccgatgcagcaggaaatactacgcatctacgaagagggcgcgctacaacaactaactaaagacgacgcagaatatgccgaaatatcgaagatatcgaagatggcgcaaccaagtgcaaaggaactactaaggtataaactgtggctagaacagaagtaccgaagcccatataccgggaaacccatatccctatcaaaactattcacgtccgcatatcagatagaacatgtgataccacaatcccgatacttcgacgacagcttcaacaacaaggtaatttgcgagtccgaagtcaataccctaaaaagcaacatgctcggctatgaatttatcaaaaaccattgcggtgagatagttcactgcaccatgctaggagacgtaaaggtcttcagcgagtccgaatacaaagcatttgtaactgaacactacagcaacaataagtataagaaggaaaaactcctgctggaggacataccacaagagtttctaaaccgccaaatgaacgacagtcggtacatcagcaaggtagtgaaaggattattgagcaacgtcgtcagaacagaggacgagctcgaagcgacaagcaaattcgtcgtatcgtgcacgggcggaatcacagacagactcaagaaagactggggcctaaacgatgtctggaacagcatagtctactcacgcttcgaacggctcaacggcctaaccaaatccgaacacttcggccactgggagaacaaagaggggaaaagggtattccaaacatcggtccccatggaactccaacgcggattcaacaagaaacgcatcgaccaccgacaccacgcaatggatgccctagtcatcgcatgcgcatcacgcaacatcatcaactacttaaataacgagttcgcaaaatcccccaaacaaagggaggacctcagacaactactctgcgataaaaacaggattatacgcaaaccctgggagaccttcacccaggacgcgcgagcggcactggaagacgtggtcgtgagcttcaaaaactatgtaagagtaataaacaaaaccacaaactactacgaaagatacgacgcagacggaaagaaaaccatggtcccacaaaaaggcaacgaaatgtgggcagtcaggaaaccaatgcacgaggggacaatgtacggaagagtgaacctgcggcgcaaagcagtcgtcaaactaaaagaagcactggaaaacatcagtagtatatgcaataaagaacttagggattacataaacgtcctggtagaaaaacagttcaacaccaagcaactgctggcccactttaagagcatggactacagatggaacaaacagcacatcgacaaagttgaagtctggcgcttcagcgacgagaaggtccaaatggtagcggcccgcaaaccgctggacacgagcttcgacaaagaatgcattgccagcattacagacacaggcatacagaaaatcctactgaactacctcgaatctaaaggaggagatcccgccatagcatttacatccgaggggattgcagagatgaaccaaaacatagccgtctacaacgacggaaagaaacaccagccggtaatcaaagtccgcaagtcgacaaaactcggaaagaaattcgccgtagggcaaatcggatgcaaaagtaaacaatttgtggtagcagaggcaggcaccaacctgtacttcgcgatatacgaagacgaagaggggaaacggtcctacgataccatcccactcaacgaagtaactgagcgcctgaagcaaggcctctccccagtaccggaaaagaacgaaaaggaggtaccgctaaaattctacctctcgccaaacgacctggtatacgtccccaccgaagacgagatgcagatgaaggaatgcaaactaaacaaagagcgaatctacaaaatggtttcaagcaccggtaacgagtgtcacttcctaccatactccgtagcctccgtcatctacaacaaggtagagttcgaaagtatgaacaaaatgggccgcgccctaaccggggagatgataaaggccgtatgctggaaactagacgtcgatagactcggcaacatcctgcgagtgataaagtga

SEQ ID NO: 6881 - RNA, 4452 nt, synthetic construct
  misc_feature 1..4452: note = Cas9 variant
  source 1..4452: mol_type = other RNA
atgaagacaatcctagggctggacctgggcacaaactccatcggatgggcaaaaatcagcatagacgataatggcaactacctacgagatattcaactgggcagcaggataatccccatgtcccaagacgtcttaggaaacttcgataacggagtcaccgaaagccagactgcggtccgcaccggatttcgcggcttgagaagaatacgggaacggagtctcctacggcgcgagagactccacagggtgctccacgttatgggcttcctcccgccacactacgacagcgcaatcggctggaacaaggaggagccaactacatacggcaaattcctaaaccacggagaaccaaagctggcgtgggaacgccaaggtgacgggtcaatgcgcttccttttcatggactcgttccacaaaatgatggaagacttcgccccacaccaacccgcactggtggcagacgggcgcaagattcccctggactggaccctgtactacctgcgcaaaaaggcactaacccaacccatcaaaaaggaggaactcgcatggatactactgaacttcaaccaaaaacgcggctactaccagctccggggcgaggaagaagaggagaaccccacaaaaagggaagaataccacgaactcaaagtggtaggtgttgaagcggccgaagaaggcaaagggggcaacacgtggtacaacgtaaaactagaaaacggatggatatatcgccgatcctcgaaaatcccactggacgactgggtgggtaaaactagaccgttcatagtaacaacagaatacgaggccgacggcatcaccctaaagaaaaacaaggagggtgaagtaaaaaggagcttcagagcgccaggcgaagatgactggggtttgtggaagaaacgtacagaatcccaactagaagccagcggcaaaaccgttggggcctttatctacgatcacctcctagccgagccagcagacaaaatccgaggaaacttcataagaacaatagagcgaaaatactacaaacaggagctagcagatatcctgcgcgagcaatccaaatatcacgaagaactgcaaagtaaaaagatcctggctgattgcgccgaagaattgtaccgatcgaaccagcctcaccgcgactccctcctgaaaaaggacatggtatacctcttgctcacagacctaatattctaccaacgaccactaaagtcaaagaaatcactaatagccgattgcccatacgaatactacgagtatgtcgacaaagagacaggagaaattaaacgacaaggcataaaatgcatcgccaaatcaaacccctactaccaagagttcagactctggcaattcgttctcaaccttaggctctacgaccgcaccgaagataaagaggtcaccgcagagtacctccccagcaaagaagactacgcaaggcttttcgtctacctcaacgacagaaaagaaatcaaccaagaaactctgctcaaagacttctttaaactcaagaaagtgaaacaaaggagcgaaaaggactttccagtacgctggaattacatagaagataaggaaaagaagtacccctgcaacgaaacgagacatgaactcctcatggccctagacagagccggcatcgaaagatcttggctcgacgacactgcccgccagtacagactttggcacctactctactcaatagaagtcaaagacgaagcagaaagagccttacgcaaactgaaggacgacgacgagttcgtcagtgcctttctgaaagtgaagcccttcaagaaagactacggggcatacagcgaaaaagcagtcaagaaacttcttgccgtaatgaggatgggaagccactggtgcgaagacgacatctgcaaggaaaccaaagagagaatcgaacacatcctacagggggacgtaggcgagaaaatcaaggaaagaatgaaccacacagcgtactcactgggggaactcagcgacttccaagcattacccgaatggctagcttgctacgttgtctacggccgacactccgaagcgacagacattaaacactggaagaccccggaatccctgatggcctacattaacggcttcaagcaacactccctccgaaatccaatagtggagcaatgcatcctcgaaacactgcgcacagtacacgacatatggaaggaggcaggtcacatagatgaaatacatgtcgaactcgggaggtcaatgaaatctacctcagaccaacgggcacgaatgaccgaaaacatcctacgaaacgagaatacaaacctacgcatcaaaagtctacttatggaactcaaaaacgacgcagatataaaagacgtacggccttactccccaatgcagcaagagatactgcgaatttacgaagaaggcgcattacaagagctaaccaaagaagacaacgactacgaagagatcttcaaaataagcaaaatgccgcaaccgtccgcaaaagaactacttaaatacaagctgtggttagagcagaagtaccgatccccatacacaggcaagcccatatccctcagcaaactcttcacaagtgcctaccagatcgaacacataataccccaaagtcgatatttcgacgattccttcaacaacaaggtaatatgcgagagcgaagtaaacgccctgaagggaaacatgctgggatatgagttcatcaaaaaccacgggggcgaaatagtgcattgcaccctcctcggagacgtcaaggtccaaaatgaaagcgaatacaaagcgttcgtaaccgaacactacgcaaacaacaaatacaaaaaggaaaaactactaatggaggatataccccaggatttcctcaaccgacatctcaacgactcccgttacatatccaaagtggtaaaaacacttctatcgaacatagtaagaacagaggacgaaatggagacaacgtcaaagttcgtggtaagctgcacaggaggaattaccgacagactaaagaaagattggggactaaacgacgtctggaactcgatcgtctactcacgcttcgagcgcctcaacgaactgacgaaatcagacgcatttggcagatgggagaacaaagagggaaagagggtcttccagacgtcagtacccctagaactacagagaggcttcaacaagaaacggatagaccacagacaccacgccatggacgcgcttgtcatcgcctgcgccagccggaacatcatcaactatctaaacaacgagagcgcgaacagcccaaagaaacgggaagatctaagacagcaactatgcgacaaaaaccggatcatccgcaaaccctgggagagtttcacgcaagacgcccgcgcagcactagaggacgtagtcgtgagcttcaaaaactacgtccgcgtaatcaacaaagctaccaactactacgagcgctacgacgcagacgggaagaaaaccataactaaacagaaaagtagggaaatgtgggccgtccgaaaacctatgcacaaagaaaccgtcttcggacacgtcaacctccgccgaaaagccatcgtaaaactcaaagacgccttagaaaacataccgtcaatttgcaataaagaactccgcgactacatcaacggcctcgtcgaacgtaacttcaacacgaaacaactacacgcacacttccggtccacagactaccgatggaacaagcaaaacgtagataaggtcgaggtatggcgcttctctgacgagaaagaaccactggtggcgacacggaagccactcgacacatccttcgacgccaaacgaatagacaccataacggacactggcattcagaaaatcctccttaactacctggaggcgaaaggaggggacccattgatagctttcacgcccgaaggcatcgctgaaatgaaccaaaacatcgcactctacaacgacggcaagatgcaccaaccaatcctaaaagtccgaataagcgagcccaagggcgccaaataccaaattggccaaacgggcaacaaagccgacaagttcgtagaagcacaaaaaggaactaacctgtacttcgcaatttacgaggacgaagaccgcaacagaacgtataacaccatcccactaaacgaggtggcagaacgactcaaacaaggacttccacccgtccctgagaaaaacgaaaaggaagtcccgctcaagttttaccttagccccaacgacctggtatacgtaccaaccgaagaggaaatcctaatgaaagagtgcaaactgaacaaaaaccggatatacaaaatggtgtccagcacgggcaaccagtgcttcttcataccgttccgggtagccgtgtcgatcgtcaacaaaatggaatactcacccctaaacaaaatggagaaagccataagtagcgaaatgatcaaggcagtgtgctggaaactcgaagtagacaggctaggaaatatcatacgtgtcgtgaagtga

SEQ ID NO: 6882 - RNA, 4458 nt, synthetic construct
  misc_feature 1..4458: note = Cas9 variant
  source 1..4458: mol_type = other RNA
atgaagaacatactcggactcgaccttggaaccaacagcatcggctgggcaaaaatcagcatagacgataacggaaaatacatcaaagatagcataaaactcggctcccgaataatccctatgtcacaagacgtcctctcaaacttttccaaaggagtcaccctcagccaaacctcagaacggacctcgttccgaggcgcacgaagactccgcgaacgcaccttactacgcagagaacgcctccaccgtatcctccacctactaggcttcctccccaaacactacgagaaagcgataggttgggaccggaacgataacaaaacctacggcaagttcatcaaccacgccgaaccaaaacttgcgtggtgcaaagacaataacggaaaaatgcgcttcctcttcatggactcattccacgacatgctatccgaatttagcgagaagcacccagaactactggccaacggaaagaaaatcccgctcgactggacgatctactacctacgcaaaaaggcactgtacaaggcaattactaaagaagaacttgcttggatcctgctaaatttcaaccagaagcgcggctactaccagctccgcggcgaagaagaccgagacagcgaggccaacaagaaagagtacctggagctcaaagtcatcggggtagaagccaccggggagaagaaaggaaatgatatctggtacaacatccacctcgaaaacgggtggatctacaggcgctccagcaaaaaccccctcaacgactggctgggaaaagtcaaatcattcatagtaaccactgatctcgatgccgacggaaacccaaagaaagacaaagacggaaatattaaaaggtccttccgcgccccgtccgagggcgattggactcttatcaaaaagcggacagagtcactattagagaactcgggacagacagtcgggcaattcatctacaaccacatcctcgaagaaccaagcgcaaaaatacgaggcaatttcatccgtacaatagagcgaaagtactacaaagacgagctcaaagccatcctcgagaaacagaaagagttccaccacgaactctcgtcggaaagcctactcacggagtgcgcaaaagaactatacaaacgcaatattgcacaccaagaagtactgcttaagaaaggcatgatccacctactgctgaatgacattctattctaccaacgcccactaaaaatcaagaaatcgctaattgacaactgtccatacgaaaactacaaatacgtggacaagaaaagcggagacataaaagtcaaaagtataaaatgcatcgccaaatccaatccatttttccaggagtttaggctttggcagttcgtctccaatctccgactctaccgcaagagcgacgacaaggacgtgacctccgagcacctcgtcaccacagatgattacgccaacctattcacatacctgaataaccgaaaggacataaagcaatccgtgcttctgaaggaatacttcaaaataaagaaagtcaagacaataaacggagccgaatacccggtgcggtggaactacatagacgacgataacaaaacctacccctgcaacgaaacacgctatgacatcctccacgcactttctaagaccgagctaaagagcgaatggctgacgcccgagagaacctacaggctttggcacctcctatactcgatagaaagcaaagaggaaaccaagaaggctttgaacaaactcaacttgtcagacgactttacggaagcgtttcttactatcaagccattcaagaaagagtacggcagctactcggagaaagcgataaagaaacttctaagcctcatgcggatgggatacctatggagcgaggacgaggcaataaaacaagtcggcgcggaaatagaaaagacaatcgaaggagaactgccagattacgtcctgcaaagactcgagaaaagccaacacaactacaataaaatatctgacttctccggactgccactatggctagcatcatacatcatctacggccgccactccgaggctaaagagataatacactgggacaaccccgagagcatgatggcatacattaaggacttccgccaacacagcatgcgtaaccccattgtcgaacaatgcgtactagaaaccctgcggaccgtacacgacatatggaaggagattggtcatatagacgagattcatatcgagctggggcgcgaaatgaaaagcacaagtgagcaacgaaaggcaatcactcagaacgtactacacaaccagaacactaacatacgcatcaaactcctcttacaagagctaaagaacgacaacaacataacaggtgtccgcccctactccccaatgcaacaggagatattacgcatatacgaggaaggcgccctccaaggactcacaaaagaagacaaagactacaacgacatcctgaaaatcagccaaacggcccaaccgacctctaacgaactcacgagatacaaactctggctcgaacaaaaataccgctctccctacaccgggaaagccatcagcttatcgaaattattcacaagcgcctaccagatcgaacatgtaatcccgcaatcccgttacttcgacgactcactgtccaacaaagtaatttgcgagtccgaagttaacaccctcaagaaagcaatgctcgggatggagttcatcaaaacatgcggcgggcagaaagtacactgtaccctcctaggcgacgtcgaaatttacaacgaggaagactacaaagcattcgtcaacgagcactactccaacaacagaaccaaaagaaacaaactgctcatggaagacatcccccaagagttcataaaccgacaacttaacgacagccgctacatcagcaaaatggtcaaacaactactgtctgctattgtgcgcggccaagaagaagtggaggcaacgtcaaaattcgtaataccctgcacgggcggaatcacagaccgcctcaagaaagactggggcctcaatgacatttggaacaacctagtaagcccgcgcttccaacgaatgaacgccctaactggctcagaatacttcggacactgggaaaacaaagagggaaaacgcgtcttccaaacaactatgcctatacagctccaacaaggtttcagcaagaaacggatagaccaccgccaccacgcgatggatgcactcgtcatagcatgcgcctcccgtaacatcatcagctatctaaacaacgagaccgcccaagataccgaacgacgcagggatctccgccaaaaactctgcgacaagggcggatccgtcagaaaaccgtgggattcattcacgcaggacacgcaatacgccctgaaggacatcatcgtgacattcaaaaactacgtacgcatcatcaacaaagccacaaactactacgaacactacaagactgacggtaaaaagggcatgattagccagaaaggcgacgaattgtgggcaatacgaaaacccatgcacaaagagaccgttttcggcaaggtgaacttgcggcgacccaagcgagtctccctatccaaagcgatagactctgtcgacgtcatatgcaatcggaaattaaagaaatacattaaagccagactcaatgagggcctacaaaagaaacagatactcaacatatttaaagaggttaacaacgtctgggaggggattgacgtaaacaaaatcgacatatgggaaatgagcaacgacaaagaaccaatggtagcaactaggaaacaacttgacaccagcttcgacgagaaaaagatccgctccatctccgacacaggaatacagaaaattctgctaaattacctgatcaccaaaaataacaatcccgaactcgcattcactcccgaaggaatccaagaaatgaacagcaatatatcggaatacaacgaccacaagaagcaccaacctatctacaaagtaagagtcaccgaaccactcggcgccaaataccccatcggaacaatgggcaacaacccaaagaaattcgtcgaagcccaagccggcaccaacctctacttcgctatctacgaagacaaagagggcaatcgcaattacgacacgatcccgctgaacatcgccgccgagcgcctcaaccagcagctgagcccagtaccagagacaaacgagaacaatacaccccttaaattctacctctcacctaacgacctcgtctatgttccatccgaagaagaacggcattccggcaacaatattcagttagacaagaacagaatctataaaatggtctccagtacctcgaagcaatgcttcttcatacatcaccgggtcgcaatatcgttagttgacaagaaagagttcagtgcccagaacaaaatggaaagaagcatagacaacgaacaagtcatgatcaagtcagtctgctggaaacttatcaccgaccggctaggcaacatcataaaagtcatcaagtga

SEQ ID NO: 6883 - RNA, 4458 nt, synthetic construct
  misc_feature 1..4458: note = Cas9 variant
  source 1..4458: mol_type = other RNA
atgaagaacatactcggtctggatctgggcactaattcgattggctgggcaaagatttccatagacgacaacggcaaatacatcaaagactccataaaacttggaagcagaatcatccccatgtcacaggacgtcctctcaaatttcagcaaaggtgtcacactcagccaaaccagcgagcgaacgagtttccggggcgccagaagactccgagaacgaactctgttacgccgagaacgactgcaccggatactccatctgctcgggttcctccccaaacactacgagaaggcgataggatgggaccgcaacgacaacaagacgtacggcaaattcatcaaccacgcagaacccaagctggcctggtgcaaagacaacaacggcaagatgcggttcttattcatggacagctttcacgatatgctcagcgagttcagcgaaaaacaccctgaactgctcgccaatggcaaaaagatccccctcgactggactatctactatttacgcaaaaaggcgctatacaaggcaatcacaaaagaagaactcgcctggatcctccttaactttaaccaaaaacgcggctactaccagctacgtggcgaggaggaccgcgactccgaggcaaacaaaaaggagtatctcgaactaaaggtcataggcgtcgaggctacaggagagaaaaagggcaacgatatatggtataatattcacctcgaaaacggctggatctaccgacgatcttctaaaaaccccctgaacgactggctagggaaagtcaagtccttcatcgtgaccaccgacctagacgcagacgggaacccgaagaaagacaaagacgggaacataaaacgatctttccgcgcacccagcgaaggagactggacactgataaagaaaagaaccgaatccctcctcgaaaattcgggacaaacagttggacaattcatctataaccatatcctggaggaacccagcgccaagatacgcggcaactttatccgaaccatcgaacgaaaatactacaaggacgaactgaaggcaatccttgaaaagcaaaaagagttccaccacgaactcagctctgagtcactcctaacggaatgcgcaaaagagctttacaagcggaacatagcacaccaggaggttctcctcaaaaagggcataatccaccttctactcaacgacatcctgttctaccaacggccactaaagatcaagaaatcgctaatcgacaactgcccctacgaaaattataaatatgtcgacaagaaatccggtgacatcaaagttaaatccattaaatgcatcgcgaaaagtaatccgttcttccaagagttcagactctggcaatttgtcagcaaccttcgcctatacagaaaatcagacgataaggacgtgaccagcgaacacctggtgacaaccgacgactacgccaatctattcacatacctcaacaaccgcaaagacatcaaacaatccgtcctgctcaaggaatacttcaaaattaagaaggtaaagaccatcaacggagccgagtacccagtgcgctggaactatatcgatgatgacaacaagacgtacccatgcaacgagacccgttacgatatattacacgccctatcaaaaaccgaactaaaaagcgaatggctcacaccagaacgcacctacaggctctggcacctactctacagcatagaatcaaaggaagaaacgaaaaaggccctaaacaaactcaatttatcagacgacttcacagaggccttcctaacaataaaaccattcaagaaagagtacggaagctactccgagaaagcgatcaagaaactgctcagcctcatgcgtatgggatacttgtggtcagaagacgaggccattaaacaagtaggcgccgaaatcgagaaaacaatcgaaggcgaactgcccgactacgtcctccaacgcctggagaaaagccagcacaactacaacaagatatcagacttcagcggcctccctctttggcttgcttcatacatcatctacggccgccacagcgaagcgaaggagataatccactgggacaaccccgagagcatgatggcatacatcaaggacttccggcaacactcgatgcgaaacccaatagtcgaacagtgcgttctggaaacactacgcacggtgcacgacatatggaaagagataggccacatcgacgagatacacatagaactcggacgcgaaatgaagagtacttcagaacaacggaaagcgatcacccaaaacgtcctccacaaccagaacaccaacatccgaataaagctacttctacaggaattaaagaatgataacaatattaccggggtaagaccttattcgcccatgcaacaggaaatactaaggatctacgaagaaggagcactacagggcctcacaaaagaagacaaagattacaacgatatactcaaaatatcacagacagcccaaccgacatccaacgagctcacccgatacaagttgtggttagagcagaagtacagatcaccttacaccggaaaggccatctcactcagcaaactgtttacctcggcgtaccaaatcgaacacgtgataccacagtcaagatatttcgacgactcactcagcaacaaagtaatttgcgaatcagaggtcaacacactcaaaaaggccatgctaggcatggagttcattaaaacatgcggcggccaaaaggtacactgtacactactcggcgacgtcgaaatttacaacgaggaagactacaaagcgttcgtgaacgagcactacagcaacaaccgaaccaagcgaaacaaactcctgatggaagatattccacaagaatttataaaccgacaactaaacgactctagatacatctccaagatggtaaaacagctcctaagtgcgatagtccgcggacaggaagaagtcgaggccacgtctaaattcgtcatcccatgcacgggcggcatcaccgaccggttgaagaaagactggggactcaacgacatatggaacaatctcgtcagcccacgattccaacgcatgaacgccctcacaggcagcgagtactttggccactgggaaaacaaagaggggaaacgtgtattccaaacaaccatgccgattcagctacaacaaggcttcagcaagaaacggatcgatcaccgccatcatgccatggatgcactggtgatagcctgcgcgtcacgtaacatcattagctacctcaacaacgaaactgcacaagacaccgaacgccgacgggaccttcgccaaaaactatgcgacaaaggaggaagcgtacgcaagccatgggactcattcacccaagacacacagtacgcactgaaagacatcatagtaaccttcaaaaactatgtcagaataatcaacaaagcaacgaactattacgaacactacaaaactgacggaaagaaaggaatgatatcccaaaaaggggacgagctgtgggccatcagaaagcccatgcacaaagagacagtcttcgggaaagtcaaccttagaagacccaagagagtatccctcagcaaggccatagactcggttgatataatatgtaaccgcaagctcaagaagtacataaaagcacgactcaacgaaggcctccaaaagaaacagatactcaacatcttcaaagaactgaacaacgtatgggagggcatcgatgttaacaaaatcgacatatgggaaatgtccaacgacaaagagcccatggtagcgacgagaaaacaactcgacacctcctttgacgaaaagaaaatcagaagcatcagcgacaccggcatccagaaaatactactaaactacctgataaccaaaaacaacaaccccgaactagcatttactccagaaggcatccaagagatgaactccaatatcagcgagtacaatgaccataagaaacaccagcctatttacaaagtccgagttaccgaaccactaggggccaaatacccaatcggcaccatgggaaacaatccaaagaaattcgtcgaagcccaagccggcaccaacctgtacttcgcaatctacgaggacaaagaaggcaaaagaaactacgacaccataccactcaacatagccgccgaacggcttaatcaacaattatcccctgtcccagaaaccaacgagaacaacacaccactaaaattctacctaagtccgaacgaccttgtgtacgttcccagcgaagaagaacggcacagcggaaacaacatccagctcgataaaaaccgcatctataaaatggtctcatcaacaagcaagcgctgctttttcatacaccaccgcgtcgcaataagcctagtagacaaaaaggagttctcagcacaaaacaaaatggagcgcagcatagataacgaacaggtgatgataaaatcggtctgctggaagctcatcaccgaccgcctgggcaatatcatcaaggtaatcaaatga

SEQ ID NO: 6884 - RNA, 4458 nt, synthetic construct
  misc_feature 1..4458: note = Cas9 variant
  source 1..4458: mol_type = other RNA
atgaaaaatatcctggggctggaccttggaacaaacagcatcggatgggcgaaaatttcgattgacgacaacggcaagtacattaaagactcaatcaagctcgggagccgcatcatccccatgtcacaagacgtactcagcaacttctccaagggcgtaactctcagccaaacctccgaacggacttccttccggggcgctcgccgcctccgtgaacgaacactcctgagacgcgaacgactacaccgaatcttgcacctactaggcttcctcccaaaacactatgaaaaagccataggctgggacagaaacgataacaagacttacggtaagttcattaatcacgcggaacccaaactcgcctggtgcaaggacaacaacgggaaaatgcgcttcctattcatggacagctttcacgacatgctgtcagagttcagcgaaaagcaccccgaacttctagctaacggaaagaaaatccctctagactggacgatctactacctccgcaagaaagccctttacaaagccatcaccaaagaagaactcgcttggatcctcctcaacttcaaccagaaaagagggtactatcagcttagaggagaagaagaccgggactcagaagcaaacaagaaagagtatctagagctcaaagtcatcggagtcgaagccacgggggagaagaaaggtaacgatatctggtataatatacacctagagaacggatggatctatcgcaggtccagcaaaaatcccctcaacgactggctcggcaaagtgaagtcgttcatcgtcaccacggacctcgatgcggacggtaatcccaagaaagacaaggacggtaacataaaacgatcattccgcgcgcccagcgaaggagattggaccctcatcaaaaagcgtacagaatccctcctcgagaactctggccagaccgttgggcaatttatatataaccacatcctcgaggaaccctccgcgaagatacgcggtaactttatacgaactatcgagaggaaatactacaaggacgagctgaaggccatactggaaaagcaaaaggagttccaccacgaactttcaagcgaaagtctactaacagaatgcgccaaagaactatacaagaggaacatcgcccaccaggaggtcctcttaaagaaagggatgatccacttactgctcaacgatatactattctaccaacgcccactcaagatcaagaaatcactcatagacaactgcccatacgaaaattacaaatacgtcgacaagaaatccggcgacatcaaagtcaaaagcataaaatgtatcgcgaaaagtaaccccttctttcaagagttccgcctgtggcagttcgtaagcaacctccgactctaccgtaaatcagacgacaaagacgtcacgtcagaacacctggtaaccacagacgactacgccaacctattcacctacttgaataaccgaaaagacatcaaacagtctgtcctactcaaagaatacttcaaaataaagaaagtcaaaactataaacggggcagaataccccgtccgctggaactatattgacgacgacaacaaaacctatccgtgcaacgaaacgcgctatgatatcctccatgctctatcaaaaaccgaacttaagagcgaatggctcactcctgaaaggacataccgcctgtggcacctactatactccatcgagagcaaagaagaaaccaagaaagccctaaacaaactcaacctatctgacgactttacagaagccttcctgaccataaaaccattcaaaaaggagtacggaagctacagcgagaaagcaatcaagaaactcctatccctcatgcgaatgggatacctatggtccgaagacgaagcaatcaaacaggtgggcgccgagatcgaaaagaccatagagggcgagctacccgactatgtactacaacgcttagaaaagtcccaacacaactacaacaaaataagcgatttcagcggcctaccgctgtggttggcttcgtacataatatacgggcgccattcggaagcgaaagagatcatccattgggataaccccgagagcatgatggcatacatcaaagactttcgacaacactcaatgcgtaaccccatagtcgaacaatgcgtcctagaaacgctaagaacggtgcatgacatctggaaggaaattgggcacatcgacgaaatacatatagagctcggccgcgagatgaaatcaaccagcgaacagcgcaaagccatcacccaaaacgtcctgcacaaccaaaacaccaacatccgaatcaagctactgctacaagaacttaagaacgacaataacattaccggcgtacgcccctactcaccaatgcaacaggaaatcctaagaatatacgaggaaggggccctgcaaggattgaccaaggaggacaaagactacaacgacatcctgaagatatcccagaccgcccaaccaacctccaacgaattaacacggtacaaactctggctcgaacaaaaataccgcagcccgtatacgggcaaagccatcagtctgagcaagctctttacctccgcataccaaatcgaacacgtcatcccccaatctcggtactttgacgactcactatcaaacaaagtcatatgcgagtcagaggtcaacacactcaaaaaggccatgttaggcatggagttcataaaaacctgcggcggacaaaaggttcactgcacactcctcggggatgtagaaatctacaacgaggaggactacaaagcgttcgtcaacgagcactacagcaacaacagaacaaaacgaaacaaactcctcatggaagacataccgcaagagttcatcaatcgacagctcaacgactcccgatacatttctaaaatggtgaagcagctactaagcgccatagtaagaggccaggaagaagtggaagcaacgtccaagttcgtcattccatgcaccggtggcataacagaccgcctgaagaaagactggggtctaaacgacatctggaacaacctggtgtccccaagatttcaaagaatgaacgcactcacaggctcggaatacttcggccactgggagaataaagaagggaaacgcgtcttccaaacaaccatgccaattcaactgcaacaagggttctcaaagaagagaatagatcaccgacaccacgctatggacgccctcgtcatagcatgtgccagccgaaacataatatcctacctcaacaatgagactgcacaagacaccgaaaggaggagggatctccgccaaaaattatgcgacaaagggggcagcgtccgcaaaccgtgggactcattcacccaggacactcaatacgctctcaaagatatcatcgtgaccttcaagaattacgtgcgaatcatcaacaaggccactaattactacgagcactacaaaacggacggcaagaaaggtatgatctcccaaaaaggcgacgaattgtgggccatcagaaaacccatgcataaagaaaccgtcttcggcaaagtcaacctacgacggcctaagcgagtaagcctgtcaaaggccatagactcggtagacgtaatctgtaatcgaaagctgaaaaagtacattaaagcacgacttaacgaaggcctccaaaagaagcagatcctcaacatctttaaagaactcaacaatgtatgggaagggatcgacgtaaacaaaatcgacatctgggaaatgtcgaacgataaagagcccatggtcgccactcgcaaacaactcgacaccagcttcgacgagaagaaaatccgctccatctcggacacaggcatccagaaaatcttactcaattatttaatcactaagaacaacaaccccgaactcgcattcacacctgagggtatccaagaaatgaactccaacatatcggagtacaacgaccacaaggaacaccaacctatctacaaggtccgcgtcactgagcccctcggcgccaagtacccaataggcaccatgggaaacaagccaaagaagttcgtagaagcacaagcaggaacaaacctctacttcgccatttatgaagacaaggagggcaatcgcaactatgacacaatacccctcaacatcgccgcagaaagactgaaccagcaactctctcctgtcccagagactaacgaaaacaacacaccgctaaagttctacctcagccccaatgacctggtatacgtcccgagcgaagaagaacggcactcaggaaacaacatccaactagacaaaaaccgcatatataaaatggtctccagcacatcaaaacagtgctttttcatccaccatagggtcgccatatccctagtcgataagaaagagttctcagcccaaaacaaaatggaacgctccatcgacaacgagcaagtgatgataaaatccgtatgctggaaactaataacagaccgactcggcaacatcatcaaagtcatcaaatga

SEQ ID NO: 6885 - RNA, 4461 nt, synthetic construct
  misc_feature 1..4461: note = Cas9 variant
  source 1..4461: mol_type = other RNA
atgaccaagatcttgggcctagacctcggaacgaacagcataggctgggccatccgcgaagacgaaaacgaaggcgtcaaccaaatcatcgataaaggggtcagaatcttctcagaaggagtaaaaagcgagaatggaaaggagatctccagggcagccgaacgcaccgcctaccgaagcgccagaaaaataaagtaccggagaaaactccgaaagtacgagacgcttaaggtcctcagcgtcaacggcatgtgtccactctccgtagaggaggtagaacagtggaaaaagtcgggcttcaaggagtatccgctaaaccccgagttcctcaactggctccgcaccaacgaggataaaaatataaacccatacttcttccgcgataaggcgagcaagcaaaaggtcaccctatttgagctcgggcgtgccctctaccacatagcacaacgtcgcggcttcctgtcaaaccgcctcgaccaatcggcggaaggcgtattcgaggagcacaacccccaaatccaaaacctcatagaggacctggactcatcgaacacaattctcaacgaacttaaagagtactacataaatctaggaataatagacgaaagcgagaaatcaggattcaaaaaggacctcgacgaaggcgaaaagaacctaaagaaactctacaccagcctagtctcaataacaaagaaaaatgccaacgacatcgaaacctgcaaacaagaactcatcgccaggctcaacaagaaagaggacctgggcaaagtcaaaggcgaaatcaaagacatcagccaggctatgctagacggcaactttaaaaccctgggccaatactttttctcattatacaataaaacaagaatacgtaaccaatacacctcccgtgaggagcactatctagaagagtttatcatcatctgccagacgcagggcatcgaggaaataaacaccaacgagaaactccccgagaagaaattcactgggctggccaaagacctttaccgagccatattcttccaacgaccactaaaaagccaaaaaggcctcattggcaagtgctccttcgagaaaaacaaaagccgctgcgccgtgtcacatcccgactacgaagagttccgcatgtggtcatacttaaatacgatcaaaataggcacacagtccgagaaaaccctacgtttcctcaccctcgaagaaaagctgaagctagtccccaaattctaccgcaagaacgactttaacttcgaagtactcgccaaagagttggtcgagaaaggggccagcttcggttactacaaaagctccaagaagaacgaatttttctactggttcaactacaagcccacggacagcgtcagcgcatgcgtggtcagcgccagcctggagaatgcaatcggaaaagactggaaaacaaaaacctttgaataccagacttccaacacaaagaaagaagaggtgaccaaatcggtaaactacaaagacctctggcacctcctctcagtcgcgacctcggacacctacctctatgacttcgccatagagaaattgaaactcgagcccaaaaacgctaaggcattcagcaaaaccaagctaaagaaagacttcgcatcgctctcactagcggcgattgccaaaatactaccatatctcaagcagggcctcctctactcccatgcggtattcatcgccaacatagaaaatatagtcgacgcagacatatggaaggacaaagaacaacagaagttcatccaatccaagatagtggatctcatagataactacctggtcgagaaatccaaactagagatcataaactgccttctgaagatctacaataccgaagacatcgaggggaggaaggtatactactccaaggaagcagagagcctatttgaggccgacctccgcaaaaagttagtacccttctataaagccaacaccatatccgaacagcaagagcaagaaatcatcttcaaggatctttttccagtcctaattgaacaacttaagaaacaagagttcataaaaatcgtaagactggacaagaaaatcgaagcctttctgaagggagaaaacgaagaaggacagatattctgcaactaccccgaaaaattcaagaagctataccatccgagcgacatcgaggtcttcaaaaagaaaatcatcaaggatgaatgggggaacgagaaggtcgtcctcggcagtccactgacgacctccatcaaaaacccaatggcaatgcgagccctgcaccaactgcgtaaagtccttaacaccctcatattggacggccaaatagacgaaaagacacggatccacatagaaatggcaagggaactcaacgacgcgaacaaacgaaaaggaatccaagacttccagaaggaacgagaagaactctataaaatctatgaggccaaaatcaaagaactctaccaagtcaagaccggaaaagaattgctccatgtcacagacgaggacctgcagaaattcgaatgggccctggaacaaaccaaggacggccgtatcatcaccaaagaggagctaatcaaatacaagatctgggaagaacaaaaccacatttgcatatacaccgggaagacaatatcgatagatagcttcctcggcggaaacccaaagttcgacatcgaacacacaataccacgtagcataagccaggacaactccctaatgaacaagacactgtgcgataaagatttcaaccgcagcgtgaaggggaaaaagatgccagtggagctgtctaactataacgagatactcccccgcatcgctcactggaagaagcaggcggaagaattgacaagacaaatagaaaccatatccagaagcatcaaaagcgccgcgacaaaagtagccaaagataaaaatattcgcaagaggcactacctcacactaaaaagagactatatccaaggaaagtacgaccgcttcacatggggagaaccgaaagtcggattcaagaactcacagatcccggacactggcatcatcacaaagtacgcccaagcctacctaaaaagctactttaaacgagtagaaagtgtgaaagggggagcggtcgccgaatttcggaaactctggggcatccaggagtccttcatcgacgaaaacggatttaaacatttcaaagaaaaagaccgaagcaagcacacacaccacacgatcgacgcaataaccattgcatgcatgcccaaggacaagtacgatctcctagcacacgcctggcgcctcgaggacgaacagaacaagaaagcagcaaaggctttgatcgaacaagccaaaccctggaaaacattcaaagaggacattgagaaaatcgaagctgaaatcctcgtatcccacttcaccccggacaacgtcaagaaacaagccaagaaaatcctccgcgtaagaggcaagaaacagtacgtggccgaaattgagcgaaatgccaacggaaaagccatcccgaagaaagacgcgtccgggaagatcatctacaagctcaacgaacgaggaaacaaaattcccatactgcagcaaggcgacaccatcagggggagcctacatcaggatagcatatacggagcgatcaaaaaccccctcaatacgaacgaaatacgctacgtcatacgaaaggacctggaatctttgaaagcgaacgacatcgaaaacatcgtagacgaaaacgtcaaggcaaaagtcaaggaagcagtcgcgaataaaatactgctgattagctccaacccacagcagaaaaataaattcgcagaaggtaaaaacgtctggatgaacgaagagaagaaaatacccatcaacaaagtcaggatctacgccaatagcgtgaaaaacccaatagagataaagaaacacagcacactgtccaaatcaaaacacgagcacaaacagacagtctacggacaaaacgatgaaaattacgctatggcactttacgaactagacggaaaacgcgagttcgaactaataaacaatttcaacttagccaaactactcaaacagggccaaggctactaccccctccacaaagaaaaagaaattaaaggcaagaaagtactcataccgatcgagaaacgcaacaaccgcgacgtcgtactcaaacggggacaacaggtagtcttctacgacaagacggtcgaaaattcaaaagacataagcgagatagtagacttccgcggccgcgtgtacctgatcgagggactgactatccaacgccaaaaggacaagaaaaccgggaaagtcaatgaatacggaatcattcagctcagatattttaaagaagcccgcaaatccgaagaaatctccaaggacagcttcaaaccggacggtgagtttaaaataaatgagaacaaacccacaaggaaaatgaatcacaaccaattcacggcctttgtggagggaattgacttcaaagtcctgccctcaggcaaattccagaaaatatga

SEQ ID NO: 6886 - RNA, 4464 nt, synthetic construct
  misc_feature 1..4464: note = Cas9 variant
  source 1..4464: mol_type = other RNA
atgaaaaacgtcttaggactcgatctgggcagcaactccgttggctgggccctcgtcaaaaccgaggacaatggaaacccgattggctcgattaagatgggatcacgaatcataccaatgagccaagacatactaggctcctttgaaaaaggggacacagtttcacaaacggctcagcgcacactctatcggggcaagcggcgcctaatagagcgacacgtactaaggcgcgaacgcctgtgccgcgtccttcacatcatgaacttcctaccagaccacttcgataagctcctcggctgggacaagaccgacaacaaaacatatgggaagttcatagacgactcagagccgaagctcgcctggagacaaaacaaaaatgagaaagagaaaatggagttcgtatttatggacagctttcacgaaatgctcagtgactttgcaaagcaccaaccacaactcatcgccaatggcaagaaagtccccctcgactggacaatctattaccttagaaagaaggcactcacccaactgatatccaaagaagaactggcatggatactcctcaacttcaacaaaaagcgcggctactatcaactccggggcgaagaagaagaagaacagcccactaagaaggaagagtacaaggtcctcaaagtcatcagcgtagacgcagatgaagggcaaaagggcaatggcatatggtacaatatacacctagaagacggcggcatttacaaacgaaagtccgacacacccctttacgattgggtgggcaaaaccctccaactgatagtagtcacaatatacgagaaagacggtaaaactcccaagatattcgattccggaaaacagaatccgtcatatcgactccccaaggaagacgactggggcctaatcaaaaagcgaaccgaatcccaaattcaatcctcaggcaaaactgtcggtgccttcatctacgacaacatcctcagcaaacccgacgacaagattcgcggaaacctcgtccggaccatcgagcgcaagtactacaagaaagaacttatcgaaatactccagcagcaagccaaataccacgacgaactccacaaccaaaacttactagagagttgcgcaaaggaactatacgcccacaacgacgtccgatacaacgaggtagtcaaatcaaatatgatacaccttttagtcgacgacatcatattctaccaaagacccttaaaaagtaaaaagagccttatagctaattgcaaatacgagtcctacgagtacgtagacaaagagacaggcgaagttaaagaaatgcccatcaagtgcatcgccaaatcaaacccctattaccaagagttccgtctctggcaattcatacacaacctcagactgtcagacgtcgtcacacgggaggatgtaacagcacaatacttgtcaaccccacaagactactgtaaccttttcacctacctcaacgaccgcaaggaaataaagcaggacatcctcctgaaagacttcttcaaaatcaagaaagttcagatcgataaggaaaaggtatttccaatcgaatggaactatatcaaagacgccacgaaaacatacccgtgcaacgaaacccgctatgagctcctatcagctctaaagcgcgcagggatggacaaacaatggctggacgacaccccaaatatgcaataccggctctggcacctcctatactcagttgaggaacaagaagagtcagccaaggccctccgaaaattgtacgacaacgataacttcgttagcagctttctcaaaataaaacccttcaagaaatgctacggcgcctacagtgagaaagctatcaaacgactcctcactctcatgcgaatgggaaaagcctgggacgaacaagccattgacgccaaaacgctgaaatgcattcaacaaataatcaccggaaacatcgacagcaaactcaaggagaaaatcgacgacagccgatacgtcctccaccacgtcagcgattttcaaggcttgcccacatacctagccagttatgtcatatacggtaggcactccgaagtcaccgacataagatgttgggacacccccaaggaccttctcaagttcatatgcggattcccacagcactccctgagaaacccaatcgtcgaacaagtaatcttagaaacccttagagtggtctatgacatatggaaagctgagaagcacattgacgaaatccacgtcgaagtcgctcgagagatgaaactgacagcacaacagagaaatgaggccaacctccgtaacctcaacaacgaagccacaaacctgaggataaagtacctcctagaggaactcaaaaacgacaccttcataaaggacgtaagacctctgtccccgatgcatcaagagaagatgcgcatatatgaacaagcagtcctggggaacctaaacaagcaagacaaagactacgacgacataataaaaatatcaaagaaagaaagaccgacctccgcggagctcatccggtacaaactctggctagaacagaaatactgttctccctacaccggaaaagcaatctcattgtcaaaactcttcacgactgcataccagatcgagcacgtaataccccagtctcgatacttcgacaactccttcaacaacaaagtcatatgcgaatcagaagtaaacaaagaaaaagacaagatgctaggatacgagttcatcaagggccgcgggggagaccggatctactgcacggcccacggcaaagaggtcactatccttaaagaagaggagtataagcaattcgtcaatgaacactacgcccacaataagagaaaacgcgacaatctcctagcggagaacatcccagaatcatttagctctcgacaactgaacgacacccgctacattacaaaaacgatcatgtccctactatccaacgtagtgcgtcagcaaggggaagaagaagctacagccaaaaacctcttgccgtcctccggagcagtaactgacaaactgaagaacgactggggactcaaggacgtctggaacaccatcgtcacaccccggttcgaaagactcaacaaactctctggcacaaacgatttcggagaaatgaaagaggagaatggcaaccgttactttcagacgaacgtaccgagcgaatacgaaaaagggttcaaaaagaaacgaatcgaccatcgacaccatgctatggatgcgctagtaatcgcatgcaccacaagaaatatggtgaactacatctccaacgtcaatgccaactcacccaaacagcgcgaagatctcaggcaactcctctgtgataagaaccgcatcatcaacaaaccttggaacacattcacgcaagacgccctaaaagccttgaacgacatcgtcgtctccttcaaaaacaacgtgagaataattaaccgagccacaaaccgctaccaacgctacgacaaaaacggcaaaaagatgatatgttcccagaaaggaaatgatatgtgggccatccgaaaatccatgcataaagagacagtgttcgggcgagtaaacctcatcagaaaagaagccctacccatcgccaaagccctggacaacatctccgccatctgtaacgcccaactccgagcctacgtgaacgacctagtggacaagcacttcaacaagaaacagctcgttgcccacttcaaaagcctagactacaaatggaaccgacaagacgtcagcaaagtagaggtgtggatcagttcggacgacaaaacaccaatggtcgccgtgcgcaaacccctagacaccagcttcgacaaaaagaaaatcgcgagcatcaccgacaccgggatccaggcaatacttttgaactacctagaatccaaaggcggggacgccctcgtcgcgttcgctccagaaggcatacaggaaatgaactcgaatatcgaattgtacaataacggaaaagcgcacaaaccaatcaaaaacgtcagactaagcgaaacattaggggcaaaataccaagttggagaacgcggggctaagaccaagaaatatgttgtcgccgacaagggcaccaacctgttcttcgccatatacgaagacgaagaggggaaacgctactattactcggtaccactacgcgaagccatcgaaaggcaaaaacaaaagttatccccagtcccagaatacaacgaaaaaggagtggccctcaaattctacctgagccccaacgacctagtgtacgtcccaacagaggaagaacgaacgatggggacatgccacatagacaaaacccggatctacaaaatggtctcgagcagcgaaaaccgatgctgtttcgtcccgagcacaatagctaaagttatcgcagacaaggtagagctgctctcgcacaacaaaatagaaaaagccattacgggcgagagcatcaaagaagtctgctggaagctaaaggtcgatcgactaggcaacatcctcaacgtcatcaagtga

SEQ ID NO: 6887 - RNA, 4464 nt, synthetic construct
  misc_feature 1..4464: note = Cas9 variant
  source 1..4464: mol_type = other RNA
atgaagaacgtactcggcctcgacctcggctcaaacagtgtaggttgggcacttgtgaaaactgaagacaacggcaaccccatcggctcaataaagatgggcagtcggataatacccatgtcacaagatatcctaggcagctttgaaaaaggcgacacggtctctcagaccgcccaacggacgttatacagaggaaaaagaagactaacggaacgccacgtcctccgtcgcgaaagactatgtcgagtgctccacatcatgaacttcctacccgaccacttcgacaaattgctcggatgggataaaactgacaacaaaacatatgggaagttcatcgacgattccgagccgaaactcgcgtggcgccaaaacaaaaacgaaaaagaaaagatggagttcgtattcatggattcattccacgaaatgcttagcgatttcgccaaacaccaaccacagctaatcgcgaacggcaagaaagtccccctcgactggacaatctactatttacgaaagaaagcgcttactcaactaatatccaaagaagaactggcctggatcctactcaacttcaacaaaaagcgcgggtattaccagctgcgaggggaagaggaagaggaacaacccaccaagaaagaagagtacaaagtgctcaaggtaatttccgtagacgccgacgaaggccaaaaaggcaacggcatatggtacaacatccatctagaagacgggggaatatacaaacggaaatccgatataccgctatacgactgggtcggaaagacactccaactgatcgtagtcaccatctacgaaaaagacgggaaaacgcctaaaatcttcgactcgggaaaacaaaatccctcatacagactccccaaagaggacgattgggggctcatcaagaaacgaaccgagtcacaaatacagagctccggcaaaaccgtaggtgcattcatttacgacaacatcctctcgaaacccgcggacaaaatcagaggcaacctggtccgcacgatcgaacggaaatactacaaaaaggaattaatagaaatcctccaacagcaagcgaaataccacgatgaacttcacaaccagcacctactagagtcctgcgccaaagaactatacgcgcacaacgacgtccgctacaacgaagtagtaaagagcaacatgatccacctactggtggacgacataatcttctaccagcggccgctaaaatcaaagaaatccctcatcgacaactgcaaatacgagagctacgaatacgtcgacaaagagacgggcgaagtcaaagaaatgccaattaagtgcatagcaaaaagcaatccctactaccaagagttccgcctgtggcaattcatccacaacctaagactatcggacgtagtaacccgagaagacgtgaccgcccagtacctttccactccacaggactactgtaacctattcacatacctcaacgatcggaaagaaatcaaacaggacatactgctcaaagatttcttccaaatcaagaaagtccagatcgacaaagaaaaagtattcccaatcgaatggaactacataaaagacgccacaaaaacttatccatgcaacgagacgaaatacgaactactgagcgccctaaagagggcaggaatggacaaacaatggctcgatgacacgccgaatatgcaataccgactctggcacctcctatacagcgtggaagaaaaagaggaaagcgcgaaagcgctacgaaaactatatgacgacgacaattttgtatcatccttcctgaagataaagccgtttgaaaagtgctacggagcatacagcgagaaagcaataaagcgcctgctaaccctcatgcgaatgggaaaggcttgggacgaacaagcgatagacgcaaagacactcaagtgcatccaacagataataacagggaacattgactcaaaactcaaggagaaaatcgacgattcacgctatgtactgcaccacgtaagtgacttccaaggcctcccgacgtacctcgcgtcctacgtcatctacgggcgccactcagaagtaacggatatacgttgctgggacacaccaaaagacctgctaaaattcatctgcggatttccgcagcattcactgcggaacccaatcgtcgaacaagtcatcctcgaaacactaagagtcgtatatgatatatggaaagcagaaaaacacatagatgaaattcacgtcgaggtggcccgagaaatgaagttaaccgcccagcagagaaacgaagcaaatctacgcaatctgaacaacgaagccaccaacctaaggatcaaatatttactagaggagctgaaaaacgacacattcataaaggacgtacgccccctaagcccaatgcaccaagaaaagatgcgaatatacgaacaggcagtgctaggaaacctaaacaagcaagacaaagactacgacgatataataaaaatctctaaaaaggaacgcccaacgagcgccgaactaatcagatacaagctctggctagaacaaaagtattgctccccatatacaggcaaggccataagcctgtctaagctattcaccaccgcctaccagatagaacacgtaatacctcaaagcaggtacttcgacaatagcttcaataacaaggtaatctgcgaaagcgaagtcaacaaagagaaggataaaatgctcggatacgagttcatcaaggggcgcggcggggaccgcatctactgcacagcgcacggtaaggaagtcacaattctaaaggaagaagaatacaaacagttcgtcaacgaacactacgcgcacaacaaacgcaaacgagacaaccttctcgcagaaaacatcccggaatcgttctcctcccggcagctcaacgacacccgttatataaccaagaccataatgtccctgctctcgaacgtagtccgccaacaaggagaagaggaggccacagctaaaaacctactaccaagctccggcgcagtcacagacaaactcaagaacgactggggactgaaagacgtctggaacacaatcgtaaccccacggttcgagcgcctcaataagctcagcggcacgaacgacttcggagaaatgaaagaagaaaacggaaaccgctacttccagacgaacgtgcccagcgaatacgaaaagggtttcaagaagaaacggatcgatcaccgccaccatgccatggacgccctagtgatagcatgtacaacccgtaacatggtcaactacatatccaacgtcaacgccaactccccaaaacagcgggaagatctgagacagctcctctgcgacaaaaaccgaatcatcaacaaaccgtggaacacgttcactcaggacgccctcaaagccctcaacgatatagtcgtgtccttcaaaaataacgtcagaatcatcaacagagcaactaaccgataccagaggtacgacaagaatggcaagaaaatgatatgctcccaaaaaggcaacgatatgtgggcaattcggaaatccatgcacaaagaaacagtgttcggccgcgtgaacctgatacggaaagaagcgctcccaatagcgaaggcgctggacaacataagtgccatctgcaacgcccaactccgggcttatgtaaatgacctcgtggataaacacttcaataagaaacaactcgtagcgcacttcaaatcgctcgattacaaatggaaccgtcaggacgtcagcaaagtcgaggtctggatctccagcgacgacaaaacccccatggtggccgtcagaaaaccactcgacaccagcttcgacaaaaagaagatagcctcaataaccgacacaggcatccaagcgattctcctgaattacctagaatcgaaaggcggcgacgccctagtggcgtttgccccagaggggatccaagaaatgaacagtaacatagagctatacaacaacggtaaagcgcacaaaccaatcaaaaacgtccgactgagcgaaacgctgggagcaaagtaccaagttggcgagcgaggagcgaaaacaaagaaatacgttgtagccgacaaaggaaccaacctattcttcgccatttacgaagacgaagaaggcaaacgctactactattctgtccccctccgcgaggccatagaacgccaaaaacaaaaactaagtcccgttcccgagtacaacgaaaaaggcgtcgctctgaaattctatttatcaccaaacgacctagtgtacgtccccacagaggaggaacgcactatgggtacctgtcatattgacaaaacacgaatatacaaaatggtcagcagcagcgaaaaccggtgttgcttcgtcccctccaccatcgccaaagtcatcgccgacaaagtggaactactatcccacaacaaaatagaaaaagcaatcacgggcgagtccatcaaagaagtgtgttggaaactaaaggtagaccgcctagggaacatcctcaacgtaatcaagtga

SEQ ID NO: 6888 - RNA, 4464 nt, synthetic construct
  misc_feature 1..4464: note = Cas9 variant
  source 1..4464: mol_type = other RNA
atgaaaaacatactagggctcgaccttggatctaacagcgtggggtgggccctagtaaaagtcgaggagaacggtaatccgataggcagcatcaagatgggttcccgcataatacccatgtcacaagacatcctgggctccttcgaaaaaggcgacaccgtatcacagacggcgcaacgtaccctttacagaggtaaacgcagactgatcgaacgacacgtcctccggcgagaaaggctatgccgtgtgctccacataatgaacttcctccccgcccacttcgaccggcttctcgggtgggacaaaacagacaacaaaacatacggcaaattcattgacgatagcgaacccaaactggcctggagacaaaataaaaacgagatgggaaagatggagttcgtattcatggactcgttccacgaaatgctcagcgacttcgcgaagcatcaaccccaactcatcgccaacggcaagaaagtgcccctggactggacgatctactacctccgcaaaaaggcactgactcagctgatctccaaagaagaactcgcctggatacttctgaacttcaacaagaagagaggatactaccagctacggggagaagaagaggaagaacagcccaccaagaaagaagaatacaaagtactaaaagtcatttccgtcgacgctgacgaagggcaaaaaggcaacggaatctggtataatattcacctcgaggacggcgggatctacaagaagaaatcagacataccactatatgactgggtcggcaaaacactacaactaatagtggtcactacgtatgaaaaagatgggaaaaccccaaaaatcttcgatagcgggaaacagaatccgagctatcgactcccgaaggaggacgactggggccttgtgaagaaacgaaccgagtcacagctacagtcaagcggcaaaacagtcggcgcgttcatctacgataacatcctatccaaaccagacgacaaaataagaggcaatctagtccgaaccatagaacggaaatactacaagaaagagctcatcgagatcctccagcagcaggcgaaatatcacgacgaactacataaccaaaatctgctagagtcgtgcgccaaagaactctatgcacacaacgacgtccactacaatgaggtaataaaaagcaacatgataaacttactcgtcaacgacataatcttctaccaacgtccgctcaaatccaaaaagtccctaatcgccaactgcaaatacgaatcctatgaatacgtagacaaagagaccggtgagataaaagaaatgccgatcaaatgtatagccaaaagtaacccttactaccaggagttccgcctatggcagtttatacacaacctccgactatcggacgtggtgacacgagaagacgtcaccgcccaatacctctcgactccacaggactactgtaatctcttcacgtacctcaacgaccgaaaagaaatcaagcaggacattctcttaaaggactttttcaaaatcaaaaaggtccagatagacaaggagaaagtattcccgatcgaatggaactatatcaaagacgccaccaagtcctacccttgtaacgaaacccgctacgaacttctatcggcattaaagcgggccggcatggacaaacaatggctcgatgacactcccaacatgcagtatcgcctgtggcacctgttatacagcgtcgaagagaaagaggagagcgccaaagcacttagaaagctctacgatgatgacaagttcgtaacctcattcctgaagattaaacccttcaacaaatgctacggcgcctactccgaaaaggcgattaaacgactcctcacactcatgcgcatgggaaaggcttggaacgagcaggcgatcgacgcaaaaacactaaaatgcatacagcaaatcataaccgacaacgtcgacagtaaactcaaagagaaaatcgacgacagcagatacgttcttcaccatgtgtccgacttccagggactcccaacttacctagccagctacgttatatacggacgccacagtgaagtaacggacatacagtgctgggactcgcccgaagacctcctcaaattcatcagggacttcaagcaacacagcctacggaacccgatcgtagaacaagtaatactggaaaccctccgggtcgtgtacgacatctggaaggcggaaaaacatatcgatgaaatccacgtggaagtcgcgagagagatgaaactcacagcgcaacaaagaaacgaagcgaacctacgtaacctgaacaacgaagccacaaacctgcgaataaaatacctcctggaagagttaaagaacgacacattcataaaagacgtccggcccctctctcccattcaccaagagaaaatgcgaatctacgaacaagccgtcttagggaacctcaacaagcaggacaaggactatgacgacattataaaaatctcaaagaaagaacatccaacgaacgccgaactcatacgatacaaactgtggctagagcaacggtactgcagcccctacacaggcaaggccatatccctctctaaactgttcacaacagcctacgaaatagagcacatcatcccccaaagccgctacttcgacaactccttcaataacaaagtcatctgcgaggcggaggtcaacaaagccaaaggaaacatgctaggatatgagttcatcaagaaacaaggcggacagaaaatctattgtacccaactcggcaaagcagtgactattctcaaggaagaagcatacaaacaattcgtaaatgaacactacgcacataataagcgcaaaagggacaacctgctcgccgaaaacataccagaatccttcagcagccgccagttaaacgatacgcgatacataacgaaaacaataatgagcttgctgagcaatgtggtacgacaacaatcggaagaagaagccaccgccaaaaacctcctgccctcctccggaagcgtaacggaccggctaaagaacgattgggggttaaaagacgtgtggaacacgatagtgacgccccgcttcgaacggctcaacaagctatccgggacgaatgacttcggagaaatgaaggaagaaaacggcaacagatacttccaaacaaacgtaccactagaatatgagaagggattcaagaagaaaagaatcgaccaccgccaccacgccatggacgcactcgtcatagcatgcaccacacgaaacatggtgaattacatcagcaacgcaaatgcaaactcaccaaaacaacgagaagacctacgacagctcctatgcgacaaaaacaggataatcaataaaccatgggacacgttcacgcaagacgctctgaaagcactaaacgacatagtggtcagcttcaaaaacaacgtccgcatcatcaacagggccacaaatcgataccaacggtacgacaaaaatggtaagaaaataatcttctcacaaaaaggagatgacatgtgggcaatacgaaaatcaatgcacaaggaaaccgtatttggccgcgtaaacctaatccgcaaagaagtcttacccatcgccaaagctctagacaacataagcgccatctgtaacgcacagctaagagcctacgtaaacgacctagtggacaaacactttaacaaaaagcaactcgtcgcccacttcaagagcctcaactacaaatggaacagacaagacgtatcaaaagtggaagtctggataagctcggataacaaaacacctatggtggcagtgcgcaagcccctagacacctccttcgataaaaagaaaatcgcgtcgatcacggacaccggcatacagacgatactcttgaactacctagaatcaaaaggtggcgacgcatccgtcgcattcgcaccagaaggcatacaagaaatgaactcaaacatcgagctatacaacaacggcaaggcacacaaacccatcaagaacgtccggctgtcggaacccctaggcgccaaataccaagtaggcgaaagaggcgcgaaaacgaagaaatacgtcgaggcagacaaagggacaaacctcttcttcgcaatatacgaagatgaggaaggcaagaggtactattacagcgtccccctcagagaagccatcgagcgccaaaaacagaaactaagccccgtaccggaatacaacgaaaaaggcgtcgcgctaaagttctacctcagccccaacgacctggtctacgtcccaacggaggaagaaaggacaatgggaacgtgccatatcgacaaagcacggatctacaagatggtatccagcacggggtgtagctgctacttcgtgccatcgacattcgccaaagtcattgtcgacaaagtagagttacaatccctcaacaaaatggaaaaagccatcaccgacgaatgcatcaaagaagtctgttggaaactcaaagtcgaccgcctagggaacatcatcaatgtaatcaagtga

SEQ ID NO: 6889 - RNA, 4485 nt, synthetic construct
  misc_feature 1..4485: note = Cas9 variant
  source 1..4485: mol_type = other RNA
atgaaaaacatactcggactcgatctgggcaccaacagcatcgggtgggcactcatcgacaacgagtctcaccgcatcattaaatcgggctcgcgaatcatacccatggacgcagcgacgatgggggactacgagaaggggaacctgaaaagcgcggactggaaacgcacctcgttccgcggaatgagacgtctgtacgaacgcgccaagctcagacgcgaacgcctgctaagagtgttaaacatcctcggcttcctaccagaggagtttcgtcgacaaatagactttgaacaccacccaggtcaattcatagacggtaaagaaccactaatcgcctaccaccacgacgaaaacggccagagggtattctcctacatgagcgcattcgaagaaatgctcacagacttccgcgcgacccagagcgagctagtacgggacggccgccgcgtcccatatgactggacaatctactacctccgccacaaggccctgacccaaccagtgacgaaagaagaactggcgtggatcatactcaatttcaacacaaaacggggatactaccaactccgctccgagtctgaagaagtgaccacaaacaaaaatgaagaatatgctgaactcaaagtggtatcggtggagaaaacgggcgaagacaagaaacgcgcaggctactactggtacaccataacatacgacaatgaagcagaacagaaaataaccagcaccataccgccacgacaaattggcgacaaagtggaactgatcgtcaccacggctcgcgacaaagcaggcgaaataaagaaatccgtccgttcaccaaaagaggacgactggaccctcatgaagaaacggaccgaacacaacatcgaggaggaagaatgcactgtaggttcgtacatctaccaacacatcctcgcggaccccaccgtcaaagtcagagggaaactcgtgcacacaattgaacgaaaattctacaagaaagaactaaaacagatactcaacaaacaaaaagagttcatccccgaacttcaagatgcgtccctatacgaggcatgcatcaaagaattgtaccgcaacaacgaagcgcacatacaatccatagcaaacaaggacttcaccgacctcttcgtcaacgacatcatcttctaccaacggccactcaaaagcaagaaatcaacaatcagcaactgcccgtacgagagttactactacaaaaacaaagagactggtgaacttatccggaaacccatcaagtgcatagccaaaagcaaccccctgtaccaagagtttcggttatggcaattcgtccacaacctacgaatatacaagaaatccgaggaagtgtctggacgactacaaacggacgtcgacgtcaccgatcgtttcctaacaaccccggacgactatgcaaaactgttcagctggctcaacgatcggaaagaaataaaacaaaaagaactcctgcgctacgaggcattcggcctctcgaaatcatacggtgactatcggtggaacttcgtagaagacaaaccctatccttgcaatgaaacccttcacgagattaaccgccgaatgaaatcaatcctatccgataaaaagctctcctccgaggcatatcagcaactctggcatatcctatacagcatcgacgatcccatagaaatccgaaaggcgctaaccagctttgcacaaaaccaggagatcaacagcgacgacttcgtaaacgctttctaccaatacgtacccgagaaaaccaaatcgtacggcgcgtactccgagaaagctatcaagaaactactccctctaatgcgccgcggaagctactgggcaatcgggaacatcgacgaaaagacccacaggagacttgataacattatcaacggagtcgcagacgactcaatatcaacatgtacacgcgaaaaattgaacaacctgacagacataaccatgtgccaaggtatgcccctctggcaagcctgctacgccgtttacgatagacacagtgaggcagcagataccacgaagtgggaacagcccgacgacatcgacacgtacttgtccacagagctcaagcagcactccctacgcaatcccatcgtagagactgtcatatcagaaaccttacgcgtcgtacgagacatctggaaagcatatggcaggccagaagagatccacgtcgagctaggacgaaatctgaaacaggacgcaaaatcccgtaaacaagacgcaatccgcatggccgaaaatgaacagacaaatcttagaatacgcgcccttctgcaagagctctctaaccccgaatgcggcgtcgagaacgtcagaccacactcaccgagccaaatggagctgcttaaaatatacgaaaacgaggtcctacaatccacggatgacataccggaagagatcagcaacatcataaaagacctaggcaaaacggacagcaagaaacgcccctccctgagcgacatcacaaaataccgcttgtggctcgaacagaaataccaaagcccctacacaggccacattataccgcttagtaaactcttcaccccagcttaccagatcgagcacgtgatcccgcagtcccgatacttcgatgacagcatctcaaacaaagtcatctgcgaagctgaagtaaacaaagagaaggatcgcatgttgggctacgagttcatcataaacaaaggaggctccattgtaaagggcagcttcggacaacagttcaaaatattcgacaaggtccagtacgaagactttgtaaagcagcgctatgcacacaacaaaacgaaaatgaagaaactacttatggacgacatcccggatggcttcatacaacgccaactaaacgactcgagatacatgagcaagaaaataatctccatcctgtccaatatcgtgcgcgaagacggcgaaaaagaagccacaagcaaacacatcattgtcacatcaggcgccattaccgaccgcctaaagaaagagtgggggataaaagacgtgtggaacgacataatagcgccacgcttcaaacgactaaacaaactcaccgacagcaacaactacggcatggagacagagaaggaaggacgccagtactttcaaatcaacgtcccaacggagttaagcaccgggctaatcaaaaagcgcatcgaccatagacaccacgctatggacgcaatcataatcgcatgcacaacacgtaaccatgtgaacttcctcaacaactcaaccgccgcctccgaccaaaaagacattcgccgagacttgcaacacacactctgcacaaaaacaaaaaccgatagcaacggcaactacgtctggaggttcaataaaccatgggacacgttcacccaagataccagacaggaattagaaggcatcatagtatccttcaaacaaaacttacgcataataaacaaaatgagtaactattaccagcactacgtagacggcaggaaaaccatcagccgacagaacaagggggacgggtgggcgatccgtaagtcactacacaaagcaaccgtaagcggaaaagtcaatcttaaaaggagcaagactgtaggcttcaaggaggccttgaacgactggtccgcaatcaaagacaaaactagcaaagccatcctgcagaaaatcatcgcgcaatacaaaaactacgatccaaaaaccattttcaaatactttaaagacagaaacttcaaagtcgaaggcaaggacttctccaagctcgaagtatactacaacacatcagacaaagagccaatgtccgcacaccgagtcaatatcgacaccaccttcgacgagaaagaaatccgatccatcactgacactggaatacagaaaatcatgcttaagcatctgcacacatacgacgacgcgcaaggaaagacccaccccgaagccgcattctcaccggaaggaatagagaaaatgaaccaaaatatccgaatgctgaatggcggtaaagaccacaaaccgatcttcaaggtacgaaaagcggaaatcttggggatgaagttcgccgtcggggaacgcggtcacaaggacaagaaatgggtcgaagcagacaaaggtacgaaccttttcttcgcgatttacgagtccgaggaaaacaaacgatcctacagcagcataccactaaatgaagcaatagaccgactcaaacgaggcgagaacatcgccgacgaacgcgaccaaaacggaaacaaactactgttcgtcctctcccccatggatctagtatacgttccagaccccgacgacgcacacatcgacgaggtcaaaggcaataacaatattttcaaaatggtcagctgcacaggaacagaatgctatttcgtcccagaaacgtacgccaatgtgatttgtaaggggaaagagctcgaatcgaaaaacaaagtggaaagctacgacggcatcaatatcaagaagtcgtgctacaagataacggtcgaccgcctgggcaaagtccgaaagatcttcaaaggctga

SEQ ID NO: 6890 - RNA, 4491 nt, synthetic construct
  misc_feature 1..4491: note = Cas9 variant
  source 1..4491: mol_type = other RNA
atgaaaaccattctaggactagacttagggacaaactccataggatgggcaaaagtatgcgtcgacgacaacggtaactacctgcgagacattaaactcggctcgcgtatcatcccaatgtcacaagacgtactgggaaacttcgacaagggtgtcacggaaagccagaccagcgtgcgcacgggcttccgcggagtccgacgcatacgagaacggagcctcctaaggcgggaacgcctgcacagagtgctacacgtgctaggctaccttcctccgcactacgacagcgcaataggatggaacaagaacgagccatcgacatacgggaaattcctaaatcatggagaacctaaactagcgtgggaacacaaagaagacggctcaatgcgcttcttatttatggagagcttccacgaaatgatggcagacttcgcaaaaagccagccgtcgctcgtgagcgacggtaagaagatcccactcgactggacgatctactacctgcgcaagaaagcgctgagccaacccattcggaaagaggagcttgcgtggcttctactgaacttcaaccaaaagagaggatactaccaactgcgcggcgaggaagacgacgataaccccacgaagtgcgaagagtattacgaactaaaggtcgttggaatcgaagcggacgaggagggcaaaaacggaaatacatggtacaacgtcaaactcgaaaacggttggatataccgccgccagtccaaaataccactggacgactggatcggcaaagtacgcgagttcatcgttacaaccgaatacgaaaaagacgggattaccctcaaaaaggacaagaacggcgacgtaaaacgatcattccgaagcccatcagaggacgactgggggcttcggaagaaacgcacagaaaaactgctcgacagcagcaagatgaccgtaggggcattcgtctacgaccacctcctggcagaaccgagcgacaagatccgaggcaaattcatccggaccatcgaacgaaaatactacaagaaagaactatatgccatcctctgcgaacagtccaaataccacgaggaactgcgatccggcgactacctgaacaagtgcgcggaggaactatacaaaaacaatcaaccacaccgaaacagcctactaacgaaggacctcgcctatctgctcctcgaggacctaatattctaccaaagaccactgaagaccaagaaatccttaatcgccgaatgcccctatgaggcgtacaaatacgtggataaagaaactggcgagataaagcgccagggcataaaatgcatagcaaagagcaacccatactaccaagagttccgcctttggcaattcatatcaaacctcaggctattcaacaaggcggacgacaaagaagtcaccgccgattacttacccacgcaagatgactacgtacgactgttcgcgtacctcaacgaccgaaaagaaataaatcaggaaaccctcctcaaagagttcttcaaactgaagaaaatcaccgtaaactcggaaaaagtatttcccatccgatggaactatatagaagacaaggagaagaaatacccatgcaacgaaacacggcacgaattgctattggcactggacagagcgcgtatagatcactcatggctggagaaaccgggacaagaatacagactctggcacctcctctacagcgttgaatcaaaagaagaaacgaaagaagccctacggaaattaaaagacgacgatgcgttcgtagaatcattcctaaaagttaaaccgttcaagcgcgagtacggcgcatacagcgaaaaagcgataaagaaactcctagccgtaatgcggatgggctcactgtggcgggagacagacatatgcgacacaactaaagggaacatcacaaaaattctccagggggaaatagacgaaaaattaaaagagaagatatccgcgtccgtttcatcttacaatcaactatccgattttcagggcctgccagtctggctcgcctgctacgtcgtatatggccggcacagtgaagcggccgaaatacaacattggaagaccccagaaagccttctggcctacattaacggttttaagcaacacagcctacgtaaccccatcgtggaacagtgcatactagaaacgctacggacggttcacgacatatggaaagaagtgggacacatagacgaaatccacgtggaactcggacgtaacatgaaaagtaccgcggaccaacgtgccagaatctcggaaaatgtcttaaggaacgaaaacactaacctacgaattaagtcactcctcctagaactcaaaaacgaccccaacatcaaggacgtccggccctacagccccatgcagcaagagaaactccgcatatacgaagagggcgtacttcaagaactcacaaaggacgacaaagacttcaccgagatcacaaaaatcagcaccatggcccaaccaagcgccaaagaactccaacgttacaaactatggctagagcaaaaatacagaagcccatacacaggcaagtctatatcactcaccaaactattcacatccgcgtaccagatcgaacacgtgatcccccaaagtcgatacttcgacgacagtttttctaacaaagtaatctgcgaatcggaggtaaacagcctcaaggacaacatgctgggctacgagttcatcaaaaaccatggcggtgaaataatacactgcacaatgttaggggacgtgaaggtgctgtccgaatcagagtacaaagcgttcgtgaatgatcactacgcccacaataaacgaaagcgggaaaacctcctgctagaagatattccacaggagttcctaaacagacaaatgaatgacagtcgatacatctcgaaagtagtaaaagcactactaagcaacattgtaagagccgaaggggaagaagaagcgacctcaaaattcgtcgtaagttgctcaggcggcattaccgaccgacttaagaaggactggggcctaaatgacgtatggaacaagatcgtctacccccggtttgaacgcttaaaccgtctaacgggcacagaagcctttggacaatgggaaaataaagacggaaaaagggtttttcagacagccgtacccctagaacttcagcgtggcttcaacaagaagcggatagaccaccgccaccacgccatggacgctctagtaatcgcgtgcacaagcaggaacataataaactacctgaacaatgaaagcgccaacaacccgaagaaaagagaggacctgagacaaaaactctgcgacaagaacaggacgatccggaagccatgggaaaccttcacgcaagatgccacggccgcactggaagacgttattgtcagcttcaaaaactacgtccgcataataaacaaggcaaccaattactacgaaaggtacgacgtggagggcaagaaagtaatagccgaacaacgaggggacgacatgtgggcaatccgaaaacccatgcacgaagccacctactacggccgcgtgaatctgcgacgcaagaagaaagtaaaccttagagtcgcccttgaaaacatctccagcatctgcgacaacaaacttcgcatatacatcaacggactcgtcgaaaaaggattcaataccaaacagatactcgacaaattcaaaaacactaacgaccacttctccatgcagaagatcgacaaagtagagatctggcaattcaccaacgaagaagagaagctcgtcgccacccggaaacccctcgacacgtcattcgacaccaagaaaattgcgtccatcaccgacacgggcatccagaccatcctgctgaactacctggagacgaaaggcggagatagcacaatcgccttcaccccggaaggcatagtagagatgaaccaaaacatcagcaaatataacaacggcaaagaacacatgcccatactaaaagtacggctctataccaaactcggcaaaaagatccccgtgggacaaacaggctgtaaagcaaagcagttcgtaatagccgaagccggcactaacctgtacttcgccatatacgaagacgaagaggggaagcgctcctacagaaccatccccctgaacgaagtggtcgaacggctaaaacaaggcctgagcccagtcccagagaaaaacgacaaggatgtacacctaaaattctatctatcgcccaacgacctcgtctacgtccccatagaagatgaacacgaatcactggccaaagaccacatatacaaattcgtcgacagcagcggcacaaccgcgaacttcatcccccaccggtcagcaaacgttatctttgaacttaacaagaaagacgctgaaaaattctgcagcgggtctatcatccaaaacgaatacggagtcggcagctctcagtctaaaaaccaaaaagcgatcactggagaaatgatcaaagcagtctgccgcaaactcgaggtggatcgcctcggcaacgtcatcaaggtaatatga

SEQ ID NO: 6891 - RNA, 4497 nt, synthetic construct
  misc_feature 1..4497: note = Cas9 variant
  source 1..4497: mol_type = other RNA
atgaagcacatcctgggactagacctggggaccaactcgatcggctgggcagtaatccgcgcccaccaagatgcagacgggcataccacactccaggatatactcgccgccgggagccggatcatacccatggatgcagctactctaaccgacttcgacaaaggaaacgcccgctcggggacggcggaaagaacctcgttccggtccatgcgccgacgccgtgaacgccaactgctccgcagagagcggctccacagagtcctcatgctcctaggcttcctgccccaacactacgccaacagtctcacccgctacggagagttcgccgacaaccgcgaatgtaagctcccctgggttaaagacgagtcagacgggaagtaccacttcctattccaagacgccttccatgaaatgtgcgaagacttccggcaactagcaccgcaatgggtcgcagatggcaaaaaggtcccatacgactggacactttattatctccgttgcaaagccctttcacgcaaaatatcaaaggaagaacttgcttggattctcctctcctttaaccagaaacgaggatactaccaagcgcgagatgaggaggacgaggttaccaccaacaaactagaagagtactacgcgggaaaggtggttcgagttgacgacacaggagaacgcaagggaaagaacgtatactacgacataaccctcgaaaatggctgggtttatcgatacgccgccaggatctacccagactgggtagggcaagtaaaagagttcatcgtaaccacaacgctaaaccccgacggaacaccaaaaacagacaaggcgggagaagtcaagcgcagcttcagaatgcccaaggacgacgactggacactcatcaaaaagaagaaagaacgggacatagacagatcccaagaaaccatcggccagtacatctaccacgccctccttaaagacccgtcacagaaaatcagaggcaaactcataggaaccgtcgaacgaaaatactataaagacgaactccgcaggatactcgacagacaaatccaattccaccccgaactacgcgaccgagaactgtactacgcctgcctccaagaattatatccatcgaacgtagcattccgaaacaccttggtcaacagggactttacctacctcttcctggatgacatcctgttctaccaacgcccccttaagtcaaagaaaagccaaatctccgattgtccctatgaagaacacttttatacagacaaggagacaggagaacgcatcagcgtaccagtcaagtgtatcgcagtcagccatccactatatcaagagtaccgcctgtggcaattcatccaaaacctacgcatctactgtcgagaagcccgaatagacggtaacttaatgattgactgggaggtcaccaacgagctcttacaaaccgaagaagacaaaaccgccctattcgactggctcaacgacaaagaatcagtcaaacaaccagagctagttgcgttcttactcggaggcaaagcaaataagaaacaaatcaaagcgtaccgctggaattatatggatgacgacacaaaaggatatccatgcaacgaaaccagagcaagcctcctaaaatacctacgcgaagcacaaaccgatagtagcttcctaacccgagaacgcgaggaagcactctggcacatcttatactccatttccgacaaaggggaactcaaaagcgcactaggaaaattcgccgtcaagcacggcctcaacgaacggtttgtcaccgtattctccaagttcccaccgttcaagaaagactacgggtcctactcggcaaaagcactcaagaaactactccccctaatgcgcatgggccatcattggcaagaagcgagcttcatcccatctacccggcagcgaatggaaaaattcatcaacggggaatacgacgactccatcgacaaacgcacatacgaaaaactcgagtccctaacagaagtctcacaatacagaggcctcccggggtggctagcctgctacgtggtctacgaccggcatagtgagggccgcgacatcgaacgatggacgagcccgtcggacatagattcctacctcgcacaattcaagcaacactccctgcacaaccccattgtagaacgcgtcgtcctcgagacactgcgcaccgtccgcgacatttggaagcaagtggaccacatagatgaaatccacattgagctgggtcgcaacatgaaactcccagccgataaaagacgccaaatgaccgagcaggcttggaaaaatgagcaaacgaacctacgaatcaaagccctgttacttgaatttgcgaggcccggctacgacattgaaaatgtccgaccctacagcccgtaccaacaagaccagctccgaatatacgaggaggctgtgctcggcgcaaacgaatgcccagacgacatcagcgcaatacttaagaaattcaacggcctcaatccacccacaagtgcggaagtccttcgctacaaatgctggttggagcaaaaataccgctcgccctacaccgggagaaccatccccctctcaaaactattcacatcagcctacgaaatagaacacataattccaaaacaacggtattttgacgacagcttctccaataaagtcatctgcgagtcggaagtaaataaaaagaaaggagccatgctcggatacgagttcataaaatcctatcatggcgcatctataaccctcaacaggggagggaccgcatcgatcttctccgtggaggcttacgaaaactttgtaaaagaacactacgctcacaaccgaggcaaaatgaaaaagctactaatggacgatgtgcccgactcctttatctcccgtcagctcaacgactcgcgatacatttccaagctaatgaaaagcatcttgtcgaacctggtccgggaagaaggggaaaaagaagctatatccaagaacttgatcgtctgcacaggcggaatcacagacagacttaagaaagactggggcatacacgatgtctggaatgacattatcttcccacgattcaaaagactagatgaaatggacagctcgcacacttacattacactaaacacccaccgacacccgataccaagcatgcccctcgaatttcaacgcggcttctctaagaaacgcatagaccaccgccatcacgccatggatgctatagtaatcgcatgcgcaacacgaaacatagtcaattacctaaacaacgaaagcgcacgacacgatgccaaaacaagccgtatggacctccagcggctcctatgcaccgccaatcgcaaactaatagataagccctggaaaacgttcacccaagatacctgcaaggtcctcgaagacatgattgtctcgtttcaacgaacacttaggataatcaacaaaaccaaaaattattacctgcgcttcgaagacggaaagaaacgaagagtgctccaaacaaaaggagacaactgggcaatccggaaacccctacacaaagaaacgttctacggagaaatcaacctacgccggatcgaaaccctctcgttaaataaagccttggaaagaataccagacatagtcgaacgcgacctacgcaagaaactaagcgaactgctaagcctcggctacaacgccaaacgtataaaaggctatttcgaagaacataaagaagagtggtcagacgtcaacctttccaaaataaaagcatactatttcacaaaacaaaagaacaagcgatatttcgccgcaagaaccgaactggacacctctttcaacaaagataagatagagaacaaaatagctgacaccgccatacagaaaatactcctacaacatcttgaggcctacgggaacgacgtcgaacaagcattctcgcccgaaggcatcgacacgatgaaccgcaatatccggcaactcaacggcggtcgctcacaccaacccatatacaaagtacgcgtttacgaagaagcaaccaaattcgccgtaggccgaagaggcaacaagtctaccaagttcgtcgaagccgccaaaggcacgaatcttttcttcgccatctacgaaatatcacaagtggacggcaatgggaaccgccaaacttcccgcaccttctcgtcgattcccctgaacgtggccgtcgagcgactcaagcaagggctaccacccgtaccggaagacgaggaaggaaacgcacccaagtacgtactttcccccaacgaccttgtttacctacctactgaaaaagaactcaagcgacgcgagattgcaatgccgatagacaaatccagaatatacaaaatggtctcatgcactggcaaagactgcttcttcattcccgccaacacagcggtccccattgtggaccgctacgaatacagctcgatgaacaaaatcggacgggccctcacgggagagatgataaaagaaatctgcctaccgctcaaaatcgaccgtctcgggcaaattatagaaatcagcaccttctga

SEQ ID NO: 6892 - RNA, 4506 nt, synthetic construct
  misc_feature 1..4506: note = Cas9 variant
  source 1..4506: mol_type = other RNA
atgaagaaaatcctagggctcgacctcgggacaaatagtatcggatgggcggttattaacaaggccgagaacgaaggcaaagacgtactatgtgggatagaggccgcaggctcacgtatcatcccaatggacgctacgatcatgggcgatttcgaaaaaggcaatagcgtttcacagacaaaggaccgcagggaacaccggtcgacccgcagactatacgagcggggtaaacttcgccgagagcgactaaaccgcgtgctatccgtgatgggcttccttcccgaccactacgtctcgcagctagaccgatatggaaagttccttagcaacaccgagcccaagctcgcatgggtcagaaacgccgactgcaagtaccatttcctttttatggactctttcagcgagatgctacaagagttcaaaacaaactcaccccaatatatctcggaagaatcgaaagttccatacgactggacactatactacctccgcaagaaggccctcacgcacaaagtcaccaaagaagaactcgcgtggatcctactaaacttcaaccaaaaacgaggctacttccagctaagagacgaaagcgaagaagaaaagaaaccctccaaaatccgccaatacttcgagcatcaaaaagtggtcgacatcatcgatacaaacgaagtctacaaagggctaaaagtgctaattgtaatactcgcgaacggaatctcgggcaagatcttcaagaaagaaatccccgactggatcggtgtggagaaagacataatagtcaaagtagacatcgacaaggacgggaaggacaaattcaacgaggacggcagtctgagttgcaggttcaacatcccaacagaagccgaatgggatacagagtgggagctcataaaacagaaaacacaaaatgacctcgacgcaagcggcaaaaccgtcggggagtacatattcgacaccctgctaagaaaccccgagcagaaaatccgaggcaaactcgtgcgcacaatcgagcgacgatactacaaagaagaaataaatgccatcctaaagaagcagaaggagttccacccagaactctctgaccgagctctttacgaaaaatgcgtagaggaactataccccaacaaccccgcccaccggaacatgatgctcatacacgacctatcctatttcctagtcaacgacatattgttctaccagaggccccttaagagcaaaaagagcctgatcgatgaatgcccatacgaaagccacctctacatcgacaagaaatccggggaacggaaaccagtggcggtcaaatgcatcgcaaaatcgcaccccctatatcaagaatttcgactgtggcaattcatatcaaacctcaggatctaccagaaaacgaaagaagtagggaacagcctcaaagtggatgtggatgtcaccaacgagttcctcaaaggcgaaaacgactacgtagaactattcgactggttgaacaccaagaaagaaatcaaacaagaggacttcctaaaatataagcccttcggcttcaccaaaggcaacataaacaactacagatggaattacgtagaagacaaaatctacccgtgcaacaaaacccactatacaatactcaaaggcctcgaaaaggcagatatcacgttcgacgagttcataagccacgattccctcgccgaagagaacctatggcacattctgtacagcgtatcatcaaaagaggagttgaaacatgccctcgaatcattcgcagacaaaaggggcctctccatcaagttcgtggacgcgtttatcaacaccccagcatttgagaaaagctacggggcttatagcgccaaggcgatcaagaaactcctcccactcatgcgcatgggaaaatactggaaagaagaaaacatttgcgacagcacacgcgagcgcatcgacaaaatcataacaggcgaatacgacgaaaatatccgcgaccgcgtcagagaaaagtccataaacctaacagacatcaccctattccgagggctcccgctctggctcgcgtgctatgtagtctacgatcgccactctgaagcgggaaacacagagaggtggacatcaccgtccgacatagaccactacatacggaaattcaaacaacactcactcagaaacccaatcgtcgagcaaatcgtcctggaaacgcttaggacagtacgagacgtttggacagaagtcggcggaatagacgagatccacgtcgaactaggccgggagatgaagaaccctagtgataagcgacggaaaatgagccttcaaatgcaagaaaatgaaaacacaaaccttcgaataaaagcactccttgccgagttcatcaacccggaattgggcattgaaaacgtccgaccgtactccccgagccagcaggacctcctaagactgtatgaagaaggagcctggaactctccggagatcgatgaaaagcaggttgacgaaatgttggccatcttgaagaaattcaacgaaactgactccagcaaaagacccactaaatcagaaataaaacgctaccgcctatggctcgagcaaaagtacagaagtccctacaccggtaccccaataccactgagcaagctgttcaccacggcctacgaaatcgaacacgtaatcccaagaagccggttcttcgacgattccctaaccaataaggtaatctgcgagagcgaagttaacaaactcaaaggaaatatgctagggtacgagttcataaaatcccactatggcgaaaaagtacaactgtccagcggctccgaagtccaaatattttcggtaaacgactacgaaaagttcgtcaaagaccactactctaagaacaaggccaaaatgaaaaagctactcatggacgacatcccagagaaatttacagagcgccaaatgaacgactcccgatacataagccgtctcattgtatcgctgctgtccaacatcgtaagagagaaaggggaacaggaatccataagcaagaatgtcctcgtgtgcaccggaggcgtgacggaccgactgaaaaacgactggggagtcaacgacgtctggaacaagatcatcctaccccgcttcaagcgaatgaatgagataaccgactcgacagactacaccagcgtaaatacctccggacacataattcctgcaatgccactccatctccaaaaaggcttcaacaagaaacggatcgaccacagacaccacgccatggacgcgatcgtgatagcgtgcgcggggagaaacatcgtaaactacctcaacaaccaatcatccaaatccgacgtaagtcgccacgacctacgaaacctcctctgcgaaaaagacaaatccgaccgaaaagaacttataataaagccctgggacacattcacgcaggacgtatacagtgtcctaagcagtatcatcgtatcgatcaagcagaacctgagagttattaacaaaacaaagaacatataccaacgcaaagaagatggcaaagtcataatcagcaaacaagaaaacaacatcaactggtgggcgatacgcaaaccgttgcataaagaaaccgtgagcggagaggtaaacctacggaaggagaccacgatttcgctcaaggaggccatagacaaccctgccaggattatagataaagacttcaagaagaagctaagagagctcatcctaatgggctacaacgagaaactcataaagaaatacttctatgacaacaacgaaagctggcaagacgtcaacctcaagaaaatccccgcctactacttcactaaagacaccaatgaccgctatttcgccagccgatcgcttctagacgagaacttcgacaaaaagaaaatagagaacaaagtcacagacacaggcatccgaaccatactactgcgacacctcgaagtcgaagggggagactccaaggtagccttttctcccgagggactcgaacgcatgaacaagaacatcgaaatactaaatgggggcaagaaacacaaacccatctataaggtacgagaatacgaaaaagcagagaaattcgcggtcggaatgcgcggtaataaagcctccaaattcgtcgaagcagccaaaggaacaaacctattcttcgcagtatacgacaatggaaagaaacgcagtttcgccacagtaccactcaacgaagtaatccgattgcaaaaggagggactacccagcgcccccgccaacgaagagggtctactgccgaagttcgtattatccccgaacgacctcgtatacgtacccacagaagacgaactgagatcgggcctactgcccgagaaccccgcaccagagcgaatatacaaaatggttagttgcaccggatatcaatgctttttcatccatttcagcgtaagcggggttctatgtgacaaaaaggaatttagctcattaaacaagatggaacgggccatttcaggtgaaatgataaaggaaatatgtatccccctcaaagtcaacagacttggcaaaataatgtataacctttga

SEQ ID NO: 6893 - RNA, 4506 nt, synthetic construct
  misc_feature 1..4506: note = Cas9 variant
  source 1..4506: mol_type = other RNA
atgaaaacaatcctcgggctggacctcggtaccaactcaataggatgggccaagataagcatcgacgacaacggcaactatctccgagacatccagctaggcagccgaatcatcccgatgtcacaggatgtattaggcaaatttgacaacggcgtgaccgagagccaaactgccgtccgcaccggcttcagaggactacgaagaatccgcgaacgatccctcctcaggcgcgaacgtctccaccgggttctacacgttatggggttcctcccaccccattacgattcagccatagggtggaacaaagaagaaccatccacatacggcaagttcctcaaccacggcgagccaaaactcgcctgggaaagacaaggcgacggcagcatgaggttcctgttcatggactcattccataaaatgatggaggatttcgcgccccaccaaccggccctagtagcggacggacgcaagataccattagactggacactctactatctaagaaagaaggcgctgacgcaacccataaagaaagaagaactagcgtggatccttctgaactttaaccagaaacgcgggtactaccagcttaggggagaggaagaagaagaaaacccaaccaaaagagaagaatatcacgaactcaaagtagtatccgtcgaagcggccgaagaagggaaaggcgggaacacatggtacaacgtcaagctagaaaacggatggatataccaccgaccatccaaaatagacctctcagactgggtagggaaaacgaagcagttcatagtgacgatggaatacgaagcagacggcataactctaaagaaaaacaaagaaggcgaagtcaaacggagtttccgtgtccccgacgaagacgactggggcctgcgcaagaaacgaaccgaatcgcaactcgaagcctccggcaaaactgtgggcgcattcatatacgaccacctactcgcagaacctgccgacaaaatccggggcaacttcatccgaacgattgagcggaaatattacaaacaggaactcgcagacattctccgggaacagtccaaataccacgaggaactccaaagcaagaaaatactcgctgactgtgcggaggaactctaccgctccaaccaaccacaccgagactccctcctcaagaaagacatggtctatcttctcctcacagatctcatcttctaccagcggcccctcaaatccaaaaagtcgttgatcgccaactgcccatacgaatactatgagtacgtagataaagaaacgggcgaaatcaaacgacagggaatcaagtgcgtagctaaaagcaacccatactaccaagagttccgcctatggcaatttgtactaaacttgcggctatacgacagaaccgaagacaaggaagtaactgccgaatacctcccatcgaaggaggactacgcccgcctgttcgtctacttaaacgaccgcaaagagataaaccaagaaacactcctaaaggacttcttcaaactcaagaaagtcaagcaacgatccgagaaagaatttcccgttcggtggaattacattgaggataaagagaagaaatatccctgcaacgagacgcggcacgaactcctcatggcactcgacagggcagggatggaaagaagctggctggacgatacagcccgacaataccgactctggcacctcctctattccattgaagtaaaagacgaagctgaacgcgcgctccgcaaacttaaggacgacgacgagtttgtcagcgccttcctcaaagtgaagccgttcaaaaaggactacggggcatacagcgagaaggcggtgaagaaactactcgccgtaatgagaatgggctcgcactggtgcgaggacgacatatgcaaagaaaccaaagagagaatagaacatatcctacaaggcgacgtagaggagaaaatcaaagaacggatgaaccacacggcatactcgcttggagaactcagcgacttccagggcctccccgaatggctcgcgtgctacgtagtctatgggcgacacagcgaagccactgacataaaacactggaaaactccggagtcactcatggcatacatcaacgggttcaaacaacactcgctacgaaacccaatagtcgaacagtgcatcctagagaccctgagaaccgtccacgacatatggaaagaagccggccacatcgacgaaatccacgtggaactcggaagaagcatgaaatcgacctcggaccaacgagcgcggatgaccgagaacatcctgcgcaacgagaacaccaatctaagaataaaaagcctgctaatggagctcaagaacgacgccgacataaaggacgttcggccgtacagccccatgcaacaagaaatcctaaggatctacgaagaaggcgcccttcaggaactcacaaaggaggacaacgattacgaagaaatattcaaaatctcaaagatccctcagccatccgcgaaagagctcctcaaatacaaactatggttagaacaaaagtaccgctctccatacacagggaaaccgatttccctaagcaaactattcacgagcgcctaccaaatcgaacacataatcccacagtcgaggtacttcgacgactcattcaacaacaaggtgatctgtgaaagcgaagtgaacgcgcttaagagcaatatgctaggatacgagttcatcaagaaccatggcggggagatagttcactgcaccctactaggggacgtcaaagttcaaaacgaaagcgaatacaaggctttcgtcaccgaacactacgcaaataacaaatacaagaaagagaaactactaatggaagacatcccccaagacttccttaaccgacacctaaatgactccagatacatatcaaaagtagttaaaaccctactcagcaacatcgtccggacggaagacgaaatggaaaccacaagcaaattcgtggtctcatgtaccgggggcataacagaccgtctgaaaaaggactggggtctaaacgacgtatggaactccatagtttactcccgcttcgaacgactaaacgaactaacgaaatcggatgccttcggccgatgggaaaacaaagagggcaaaagagtcttccaaacgtccgtccctttagagctacaacgagggttcaacaagaaaagaatagaccaccggcaccacgccatggacgccctagttatagcctgcgctagccgcaacataatcaactacttaaacaacgaaagcgcgaacagccctaagaaacgagaggatctccgccaacagctctgcgataaaaaccgaataatcagaaaaccttgggagtccttcacacaggacgcccgtgcagcgctagaagatgtcgtcgtgtcatttaaaaactatgtcagggtgattaacaaaacaaccaactattacgaacgatacggggccgatggagagaaaacgatcgccaagcagaagaacagcgaaatgtgggcagtgagaaaaccaatgcacgaagctaaatactacgggcgggtcaacctgcagagaaaaacggaagtaagactcaaggccgcgttagaggacatcccgagcatttgcaacaaggaattacgtgactatatcaatcgactcgtcaaatcggggctaaacgcgagacagctcctcgcccacttcaaaagcacagactactgctggaacaaacaaaacgtagacaaagttgaagtatggcgcttcagcgatgaaaaagagccattagtcgccatcagagaaagccttgatacctccttcgatgccaaacggatagacacaatcacggacacaggcattcagaaaatactactaaactacctagaagccaagggcggtgacccggcaatcgcctttacaccagaaggaatcgcggaaatgaaccaaaacatggccctctacaacaacggcaagatgcaccaaccaatactccgagttaggctcagcaagaaaagaggcaaaaagtaccaagtgggccagaccggctgcaaagccaagcagttcgtcataagtgagagcggcacaaacctctacttcgcgatttacgaagacgaagaccgtaaccggacctataacaccatcccactcaacgaagtagcagaaaggctaaaacaaggactgagcccagtccccgagaagaatgaaaaagaagtccccctcaaattctacctttcccccaacgacctagtgtatgttcccacggaagaggaaatcctcatgaaagaatgtaagttaaacaaaaatagaatatacaagttcattgacagcagcggaactacagcaaatttcgtaccacaccgcagcgccagtctaatctacaacgtagacaagaaactggccgaagcattctgtaacgatgaaataatccagaacgaatacggggtaggatccccacagagcaaaaaccagaaagcactaacgggggaaatgataaaggcagtttgttggaagttagaggtcgatagactcggcaatatcatacgagtcataaagtga

SEQ ID NO: 6894 - RNA, 4515 nt, synthetic construct
  misc_feature 1..4515: note = Cas9 variant
  source 1..4515: mol_type = other RNA
atgaaaaatattgtcggcctagacctaggaaccaacagcataggctgggcggtagtcaatggaaacataaacgacgacggcagcgagcagctggttaaaatccaagcgtccggcagccgtataatccctatggacgccgctatgatcggggacttcaacaaagggaacagcatctcccagaccgccgaacgcacccgactacgcggcatccgaagactctcagaacgatacctattacggcgggaacggctccaccggatcctcgacatcctaggcttcctaccgtcacacttcgcccgggacctagaccgctacggcaagatcgtcaaggacaaggagccaaaactagcatggcgcaaaaacgaagccggacaattcgaatttatcttccaaaactccttcaaggaaatgctagaggacttcaagctcaaccatccaaacctcataacggacgacaaaaaggtcccttacgactggacaatctactacctacgaaagaaaggactaacctcaaagataagcaaagaagaacttgcgtggatattgctcaacttcaaccaaaagcgaggctactaccagcttagaggggaagaagaggaagaaaacaaaaacaaacaagtcgaattttacgcactaaaggtcatcgccgttgaagacagcggagagaagaaaggcaaagatacatggtacaacgtacacctagaaaacggatggatttaccggagaaccagcaatatgccacttgactgggtaggtaaaaccaaagagttcatagtcaccactgacctggaaaaagacggcacccctaaaaaggacaaagaaggaaatatcaagcgctcatttagagcacctaaagaagacgactggtcactggtcaaaaagaaaactgaagcagacatagatcagacacacaaaaccgtaggcacatatatatacgacaccctgctaggcaacccatcacagaaaatccggggacgcctcgtacgcaccatcgagcggaagtactataaagaggaactgaaactcatcctagacaaacaaaaggagttccaccccgaactacaagaccgcgcgctctacgctgcgtgcgtagaggaactgtacacaattaacgaggcacatcgcaacaatatcggcaatcgagacttcacgtacctcttcctcgaggacatactcttctaccagcgaccactgaaatcaaagaaaagtctaatcgataactgcccttatgaagaaaaccattgcctcgacaaggagacgggtgagatcaaattcttcccagtcaaatgcatagccaagtctcaccctctcttccaagagttcagactgtggcagttcattgtgaacctccggatttacaggaagggattagcccaagacgtagatgttacgaacgaactacttaagaccgaggaggactacgtcgcactgttcgactggctcaatggcaagaaagaaatcgaccaaaaagccttccttaaatatccccctttcggcctcaagaaagaggtcgaaaactaccggtggaactacgtacaagacaaaagttacccatgcaacgaaacgcgtagcctcatgctcgcccgactagaaaaatgcgacatctcaatagagttcctcaccaaagaaaacgaagaagcactctggcacattctttacagtgttgaggacaaaaacgaaatcgtcaaagccctacaaaaattcgcggataagcataaccttaacgctagcttcgttgacgtgttccagaagttcccgagcttcaagaaagagtacggtagttactccgcaaaagccatcaagaaacttctcccactgatgagaatgggcaaatattggtccgaagacagcatcgacaaaggcacaagggagcgcatggacaaaataatcaccggagaatatgacgagaaaatagaaaaccgagttcgtgaaaaagcaatacacctcgcagacatttccgagttcaagggactaccactatggctggtatgttacatcgtatacggaagacactcagaatccaaagaaatcgctaaatgggaatccccagccgacatagactcgtacctcaagagcttcaagcaacacagcctaagaaaccccatcgttgagcagataattatagagacacttcgcgttgtccgagacatttggaaacaggtgggcaacatagacgaaatccacgtagagctagggcgggaaatgaaaaacccggccgacaaacgaagaaagatgacccagcagatttctgaaaacgagaacacaaacctacggatcaagtacctactcaccgagttccttaacccggaatacgaagtcgaaaacgtccgaccatactcacccagccaacaggatatactaaggatttacgaggaaggagtcctgaactcagtgtccaacctccccgaggagatctcagacatactcaagaaattcacggagacggacctcaagaaacgccccagccggagcgaagtacttcgctacaaactctggctcgaacagaaatatcgcagcccttacacgggcgaagtcataccactgggcaaattattcacgccggcatacgagatcgaacacgtcatcccccagagcagatactttgacgacagcttctctaacaaagttatctgcgaagcggaggtcaacaagctaaaatcaaacctcctagggcacgagttcatcgtcaagcaccacggcgaaatagtcgagctccccttcggaaagaaggtaaagattttcacagtcgacgagtacgagcagttcgtcaaagacaactactcccgcacccgagggaaaatgaagaaactcctagtagacgacatcccagaagagttcgtcgctcgacagttgaacgacagccgatacataagcaaagtcgtcaaatcactcctatcaaacatcgtgcgggaaaaaggcgaggaagaggcaatcagcaagaacgtcattccatgcacaggaggagtcacggacagactcaagaaggactggggtgtcaacgacgtctggaataaaataatcctcccccgatttcaacgtctcaatgaactaaccgggaccaacaaattcactacaatgagcctcaataaccacgaaatacccgccatgcccctggaactacaaaaaggcttcaacaaaaagcgcatagaccaccggcatcatgcaatggacgcaataataatcgcgtgtgctaataggaacataataaactacctaaacaacgagtcagctacggccaaggcggagctgtcacgctatgatctccagcgcctgctatgtgacaaggccaagacagacgacaacggaaactataaatgggtcatccgcaagccttgggcttcattcacccaagacgtacacggcgtcctcgaagatatcatcgtcagcttcaaacaaaacctgcgtgtcatcaacaaagcaacaaatcactttctccactacaacgaggaagggaagaaaattttcgtgaaacaagaaaagggagacagctgggcaatacgcaagtcaatgcacaaggacacggtttttggggaggtgaacctccgcaggataaaaaccgtcgcgctaaacgaggcaatgaaaaacccccagagcatcgtagtcaaagacttcaagcgcaaactcctcgagctcctaaacctgggcttcgacgccaaacgcataaagaagtacttcgaagacaaccgggaaacctggtccgacataaacctcagtaagattaccgtatattatttcagcaaagacaccaaggacagattcttcgcgactagaaagcccctggacacaagtttcgatcgaaagaaaatcgaaaacaacataacagacacaggaatacagaaaatactcctgcgccacctggaacttaaagacaataaccccgacatcgcctttagccccgacggcatcgacgaaatgaaccgtaacatcatccaactcaacaacggcaaataccaccaaccaatcataaaagtcagatggtatgagcaagccgacaaattcgcagttggccaaacgggaaacaaatcctcaaaattcgtagaggcagccaagggaacgaacctcttcttcgcagtctatgagtcaaacatcctagacgaaaagacaaacacgataatcaagaagcgaaattacgccacgatccccctaaacgtagccatcgaaaggcaaaagcaaggactgagcgtcgcacccgaagaggaaaacggcaacgacccaatattcgtacttagccccaacgacttggtctacctgccaacaacggacgagctcgcgaacggggtagtggcgcagccgctcgacaaagagcggatctacaaaatggtctcatgcaccggcaacgaaggacatttcatacccgcccggatcgcaaacccaatactccagactatagaactagggtccaataacaaggcccagaaagcctggacggatgagatgataaaggagatctgcatgcccatcaaagtcgaccgcctaggaaacatattggaatcctctagccttcacaagaaatga

SEQ ID NO: 6895 - RNA, 4515 nt, synthetic construct
  misc_feature 1..4515: note = Cas9 variant
  source 1..4515: mol_type = other RNA
atgaaaaacatagttggcttggatctcgggaccaacagcatcgggtgggcagtcgtgaatggctccgtaaacgacgacggatcagaacagctcgtaaaaatccaagcatcagggtcccgcatcatccccatggacgccgccatgataggggacttcaacaaaggaaactcgatcagccaaacggccgaacgcacccgactccgcggggtgcggcggctcagcgagcggtacctcttacggagagaacggctacatcggatcctcgacattttaggttttctacccttccactttgcacaggacttagaccggcacggcaagatcgtaaaaggtaaggagccgaaattggcatggcgcaaaaacgaagccggccagttcgagttcatctttcaggatagcttcaaagaaatgctggaagacttcaaactcaactacccgaacctaatcacagacgacaagaaagtaccctacgactggaccatctactatcttcgaaagaaaggattgacgtcaaaaataagcaaagaagaactagcctggatactccttaacttcaatcagaaacgaggttactaccaactccgtggcgaagaggaggaagaaaacaaggataaacttgtcgagttctacgccctgaaagtcgtagccgtcgaggactcgggagaaaagaaagggaaagatatttggtacaacgtccacctggaaaatggctgggtttaccgtagaaccagcaacatgagcctagactgggtcggcaaaacaaaagagttcatagtcaccacagacctagaaaaagacggcaccccgaagaaagacaaagaaggtaatgtaaaacgctccttccgggcccctaaagaagacgattggagccttgtcaaaaagaaaacggaagcagacatagatcaaacccacaaaaccgtaggtgcatacatatacgacaccctcctgggaaacccctcccagaaaatacgtggccgactcgtccgtactatagagcgcaagtactacaaagaagaactcaagctaatacttgaaaaacaaaaagagttccacctagaacttcaagaccgcgccctatacgccgcctgcatcgaggaactgtaccccatcaacgaggcacacaggaacaatgtaggcaaccgcgacttcacgtacctgtttctcgaagacatactcttctaccaaaggccactcaaatccaaaaagagcctaatcgacaactgcccttacgaagaaaaccaaggcttagacaaagagacgggggaaataaagagcttccccgttaaatgcatcgccaaatcccaccccctcttccaggagttccgcctctggcaattcatcattaacctacgcatctaccgcaaagacctcgcacaagacgtagacgtaacaaacgaacttctgaaaactgaagaagattacgtagccctcttcgactggctaaacggtaagaaagaaatagaccaaaaggctttcctaaagtaccccgtcttcgggctgaagaaagaaatcgaaaactacagatggaactacgtacaagataaaccgtacccatgcaacgagacccgctccctaatgctcgcacgactggaaaaatgcgacatcagcatagagttcctcactaaggaaaatgaagaagccctatggcatatcctttactcagtcgaggacaaaaacgaaatcgtgaaagcactgcaaaaattcgcagacaagcacgatctgaacgcctcattcgtcgacgtcttccagaagtttcccccattcaagaaagaatacggctcatacagcgctaaagcgataaagaaactactgcccctaatgcgcatgggcaaatattggtccgaaaacagcatcgacaaaggcaccagagaaaggatagacaaaataataaccggcgagtacgatgagaaaatcgaaaatcgggtacgggagaaggctatacacctcgcggacgtctccgactttaaagggctcccactatggcttgtatgctacatagtatacggtcgccacagcgaggctaaggaaataatccaatggaagtcgcctgccgacatcgactcatatctgcgctcgttcaaacagcactcgttaagaaacccaatcgtcgagcaaataatcatcgagacactccgcgttgtccgagacatctggaagcaagtagggaacatcgacgagatccacgtcgagctaggtcgcgaaatgaagaacccggcagacaaacgcaaaaagatgacacaacaaatgagcgaaaacgagaacacgaatctccgaatcaagtacctactcacagagttcctcaatccagagtacgaggttgaaaacgtccgcccgtacagcccaagccaacaggacatccttcgaatctacgaagagggtgtcctgaactccgtaagcgacctgccagaagaaatatcggacatcctcaagaaattcacggaaacggatctaaagaaacgtcccagccgatccgaggtactaagatacaaactatggctggaacaaaaatacagaagcccgtacacgggcgaagtcatcccgctcgggaaactcttcacaccagcctacgaaatcgaacacgtaataccgcaaagctgctactttgacgacagcttctcgaacaaagtaatctgcgaagcagaagtcaacaaactcaaatccaacctactcggtcatgagtttattgtgaaacaccacggcgaaatcgtagaactgccgttcggcaagaaagtcaggatcttcaccgtggacgagtatgagcaattcgttaaagacaactactcccgtacgcgcagcaaaatgaagaagctgctcatggacgacattcccgaagagttcgtcaccagacaactcaatgacagccgatacatctcaaaggtggtcaagagcctactttctaatatcgtacgggaaaaaggcgaagaggaggccatttccaaaaacgtgatcccctgcacagggggcgtaaccgaccggctcaagaaagactgggggataaacgaagtctggaacaaaataatactgccacgattccaacgtctcaacgagctgacgggaaccaacaaatttacaacgaagaacgtcggcatccaggagatccccacaatgccactcgagctccagaaaggtttcaacaagaagcgaatcgaccatcgacaccacgcaatggatgcaatcatcatcgcctgcgcaaaccgcaacataataaattacctgaacaacgaaagcgcgaccgcaaaggcggaactgtccagatacgacctacagaaaatgctatgcgacaaggcgaagacggacaacaacggcaactacaaatgggtgatacgcaaaccctgggcatcgttcacacaagacacgtacttagcactcgaaaacatcatcgtcagctttaagcaaaacctgagggtgatcaacaaagcgacgaaccgctttctccactacaatgaagagggcaagaaaatattcgtgaagcaaggcaagggcgacaactgggcaatccgaaaatccatgcacaaagacaccgtcttcggagaggtcaacctccgacgaatcaaaacagtagccctcaacgaggcgatgaaaaacccccagagcatagtcgtaaaggacttcaagcggaaactactggaactctggaacctcgggttcgacgccaaaaggatcaagaaatactttgaagataaccgcgaaacatggtcagacattaacctcagcaaaatcgaagtgtattacttctccaaggacaccaaggaccggttctttgctactcgaaagcccctcgacacgtcattcgaccggaagaaaatagagaataatataacggacacaggcatacaaaagatcttgctgcggcatctagaactaaaagataacaacccagatatcgccttcagtccagacgggatagacgagatgaaccgcaacataatccaactcaacaacggcaaataccaccagccaataatcaagatccgatggtatgaacaagcggataaattcgcggtcggccagacgggcaacaaatcctcgaaatttgtcgaagcagccaaaggcaccaacttattctttgccgtatacgagagtaatattttggacaagaaaacgaacacaatcatcaagaaacgcaattacgctaccatcccactgaacgtagcaatcgagcggcagaaacaagggctgcccgtcgcacccgaagacgagaacggcaatgacccgatttttgtgctttcacccaacgacctagtctatctgccaaccgacgacgagctagccaacgggataatcgcccaaccgctcgaccgaggaaggatctacaaaatggtatcatcctcaggcgaacaatgcttcttcattaagcacatagtcgcgaacgtcctagttgataaattcgagttctcacccctaaacaaaatggaacgcgccctcactggagaaatgataaaaatgatctgtatacccataaaagtggaccgactcggaaacgtactcgaatcgtcaagctcatacaagaaatga

SEQ ID NO: 6896 - RNA, 4515 nt, synthetic construct
  misc_feature 1..4515: note = Cas9 variant
  source 1..4515: mol_type = other RNA
atgaaaaacatagtaggcctagacctaggaacaaactccatcggctgggccgtcgtcaacggctcagtaaacgacgacggaagcgagcagctcgtcaagatccaggcttccgggagcagaatcatccccatggacgcagcgatgattggagacttcaataaaggaaattccatatcacaaacagctgaacgaacaagactgcgaggcgtccgcagattgtcagagcgctacctcctccggcgcgagcgactgcaccgaatactcgacatactaggattcctgcccttccacttcgcccaagacttagacagacacgggaaaatagtaaaagggaaagaacctaagctggcgtggcgcaagaacgaagcagggcaattcgagttcatctttcaagacagtttcaaagaaatgctggaggacttcaaactaaatcacccgaacttgatcaccgatgacaaaaaggttccgtacgattggacaatctattatctaaggaagaaaggcctaacgagcaagatatcgaaagaggaactagcatggatcctactaaacttcaatcagaagcgaggatattaccaactcagaggagaggaagaagaagagaacaagaacaagctagttgagttctacgcactgaaagtcgtcgcagtagaagactccggcgagaaaaagggaaaggacatatggtataacgtccacctagaaaacggatgggtatacagacgcacatccaacatgccactcgattgggtgggcaagaccaaagagttcattgtcacaacagacctagagaaagacggcacccccaagaaagacaaagaaggcaacgtgaaacgcagcttccgagccccaaaggaggacgactggtcgctggtaaagaagaaaactgaagctgacatagatcagacgcacaagacggtaggcgcatacatctacgacaccctcctcggcaaccctagccagaagatacgaggccgtctggtaagaacaatcgaacggaagtactacaaggaggaattaaagcaaatactagaaaagcaaaaagagttccacctagaactccaagaccgggccctatacgcagcctgcattgaagaactctaccccatcaatgaagcccacagaaacaacgtaggaaacagggacttcacctacctcttcctagaagacatcctgttctaccaacgccccctcaaaagtaagaaatccctcatcgacaactgcccgtacgaggaaaaccaagggctagacaaagaaacgggggaaatcaaatcattcccagtaaaatgcatcgcgaaaagccaccctctatttcaggagttccgactatggcagttcataatcaacctacgaatctaccgcaaggacctcgcccaggacgtagacgtaaccaacgaactcctgaagacagaagaagactacgtggcactattcgactggctcaacgggaagaaagaaatcgaccagaaggccttcctcaaatacccagtgttccgactaaagaaggaaatcgaaaactaccggtggaactacgtccaggacaagccctacccgtgcaacgagactcgatccctaatgttagcccgactagaaaagtgtgatataagtatcgagttcttaacaaaagaaaacgaagaagcactctggcacattctatactccgtagaggacaaaaatgaaatagttaaagcactacaaaaattcgcagacaaacacgacctaaacgcctcctttgtggacgtgttccagaaatttcccccattcaagaaagagtatgggagctactccgccaaagccataaagaaattactgccgctaatgcgcatgggcaaatactggagcgaaaactcgatcgacaagggaacgagggctcgcatcgacaaaatcatcaccggagaatacgacgaaaagattgaaaaccgcgttcgcgaaaaagctatacatctggcagacgtcagtgacttcaagggcctaccgttatggctcgtatgctacatagtatacggaagacactcagaagccaaagaaatcatccagtggaaatccccggccgatatagattcatacctacgcagcttcaaacaacactcactccgcaaccctatagtagaacagattatcatagaaacactacgcgtggtgcgcgacatctggaagcaagtgggtaacatcgacgaaatacatgtggaactgggccgggagatgaagaaccccgcagacaaacgtaagaaaatgacccaacaaatgtccgaaaacgaaaacaccaacctgcgcataaaatacttattaaccgagttccttaacccagaatacgaagtcgaaaacgtacgaccatactcaccctcccaacaagacatactacgaatctacgaagaaggagtcctgaactcggtcagcgacctccccgaagagatcagcgatatccttaagaaattcacagagaccgacctcaagaaacgaccatcgcgaagcgaaatcctacgctacaaactttggctcgaacaaaaataccgcagcccctacacgggcgaagtaatccccctcggtaaactctttacaccagcatacgagatcgagcacgtcataccgcaatcatgctacttcgacgactcattctcaaacaaagtcatatgcgaggccgaagtgaacaaactcaaaagcaacctactgggacatgaatttatcgtgaaacaccacggggagatagttgaactccctttcggcaagaaagtccgcatcttcacagtcgacgagtacgaacaattcgtcaaagacaactactcacggaccagatccaaaatgaagaaacttctaatggacgacatccccgaagagttcgtaacccgacagcttaacgacagccgttacatcagtaaagtcgtcaagagtctactaagcaacatcgtccgagaaaaaggcgaagaagaggccatcagcaagaacgtaataccgtgcaccgggggagtcaccgaccgccttaaaaaggactggggtatcaatgaggtctggaacaaaatcatcttaccacggttccagcgactaaatgagctcacgggcaccaacaaattcactaccaagaatgtgggactgcaggaaatccccactatgcctcttgaactccaaaaaggcttcaataagaaacgcatcgaccaccgacaccacgcgatggacgccatcatcatagcctgcgccaaccgaaacatcattaattacctaaataacgaatccgcaactgcaaaagcggaactaagccgctacgaccttcagaaaatgctttgcgacaaagctaaaaccgacaacaacggcaattataaatgggtaatccgcaagccctgggccagcttcacacaagacacttacttggcactggaaaacataatcgtcagcttcaaacaaaatcttagagttataaacaaggccaccaaccggttcctacactacaacgaggaaggaaagaaaatcttcgtcaaacaaggcaaaggggacaactgggcaatacgcaaaagcatgcacaaggacacggtattcggcgaggtaaacctcaggcgcatcaaaacagtcgccctcaacgaggctatgaagaatccgcaatcgatagtggtgaaagatttcaagcgaaaactgctagagctgtggaacctgggattcgatgccaagcgcataaagaagtacttcgaagacaaccgcgaaacatggagtgacatcaatttgagcaagattgaggtatactacttctccaaggataccaaggacaggttcttcgcgacgcgaaaaccgctcgatacatctttcgaccggaagaaaatcgaaaacaacatcacggacaccggaatccagaaaatactattacgccatctagaactgaaagacaacaacccggacatagcattcagcccggatggcatagatgagatgaacagaaatataatccagcttaacaacgggaaataccaccaacccataatcaaagtgcgctggtatgagcaggcagacaagttcgcagtcggccaaaccggaaataaattctcaaaatttgtagaagccgcaaagggaaccaacctattcttcgcagtgtacgaatcgaacatccttgacaagaagacaaacaccatcatcaagaagcgaaactacgccacgatcccgctcaacgttgcaatagagcgacaaaaacagggcctcccagtagccccagaagacgaaaacggaaacgaccccatcttcgtgctaagcccaaacgacctagtatacctacccaccgatgacgaattagccaatggcataatcgctcagccacttgaccgtggccgaatctacaaaatggtctcgtcgtccggggaacagtgcttcttcataaaacacatagtcgccaacgtgctagtagacaagttcgagtttagccccctcaataaaatggaacgcgccttaaccggagagatgatcaagatgatttgcataccaataaaagtcgaccgcctggggaacgtcctcgagtccagcagtagccacaagaaatga

SEQ ID NO: 6897 - RNA, 4515 nt, synthetic construct
  misc_feature 1..4515: note = Cas9 variant
  source 1..4515: mol_type = other RNA
atgaaacgaatcctgggcctcgatctcggcacaaacagcatcgggtgggccctcatagaaaacgactttaatcgtaaggaaggcaagattgaggctctgggatcgcgcataatccccatgagccaagatatcctcggcaaattcgactctggcgtcacagtctcccaaactgcggcccgaacaaactacagaggaatacgtcgactctaccagcgtgacaacctgcgcagagaacgattacaccgagtactcaacattctagggtttctgcccaagcactacgcagaatctattgacttcgaagatagactaggacaatttaaaccagaaacagaagtgaaacttccatatcgaaaggactctgacgacaactaccacttcatcttccaggaatccttcaatgagatggtcgaggagtttcaattcaaaaaccccagcctgttctacacgaaagcaaacggagaacaatcaaaaatcccgtacgattggaccttgtattacttgcgcaagaaagctctctcgaaaaagatatccaaagaggaacttgcatggatactcctcaatttcaaccagaaaaggggatattaccaactgcgcggcgaagaagaagctgattctaaagacaagctcgaggaatatcatgccctgaaagtatctgacgtacaagccacggaagacacaaacgccaagggcacatggtacaacgtaatactcgaaaacggctggatataccgacgacagtcaaaggacagtctgttcgactggaaaggaaaaactcgtgagttcatcgtcacgacttccttggaaaagggaggcgcggtgaagatagacaaagagggcaacgaaaaacggtcattccgcgcagtggatagcgaaaaagattggatagccattaaaaagaagaccgaaaacgaccttgcaaacgccggcaccacggtaggagtctacatatacgaaaccctactaagaaacccagaccagaaaatccgcggaaaactcataaaaacgatcgaacgaaaatactacctcgaggaactgaaggcaatcctggccaagcaaatccaagagcacgctgaacttcaaaaccgatcgctatataaggactgtatcgaagaactataccaaggcaatgaagcacacaaaaataacataaaagaaaacggcttcgactacctattcctcgaggacataatattctatcaacggcccctaaagagcaagaaatcgacgatcagcaactgcccatacgaatcacgcgtatttatcaaagacggcaagaaggaaatacaacccatcaagtgtatctcgaagtcaaacccaatctaccaagaatttcgcctgtggcaattcatacataacctcaagatatacgaaaaagaagcaatcgacgacggaaaaactgtcataaacaaagacgtaacaacagagttcctaaacacacaagaggcgtacgcggcactcttcgagttccttaacgataaagcggaaatcagccagaacgcgctcctcaagtactttaaacttagtaccaacacacaccggtggaacaacgtcgaagacaagaaatacccatgcaacgaaacccgctcggagttcataaagcgcctgagcaaaatggacggtattgacctgggcaagacactaagccccgcgttcgaaaagtccctatggcacatcatctacagcgtgaaagacaagaaacagtacgtacgggccctagaaaccttcgcaatgaaaaacgggttggacataaaccagtttcgcgaaaacttcgaaaaattcaaaccgtacgacagcgcgtacggcgcatattccgaaaaagccctcaagaaagtgctccccctaatccgccgaggcacctactggaagaaagacgcaatcccggccgctgtgcaagagaggatcgtgaacatcatgaaacggattgagtctgtcgacttcaatctcgagaaaattgaaaacttcgccgacgacgacatcccaaagcagctcctaaagagtttcgccaaaggcaaagatccaatgcaaggcctgaacacctaccaagcgtgctatgccgtctacaacaggcactccgaagtgagtgacatccagctgtggaaaagtccagaagacataaccaaatacctcgattcattcaaacaacacagcctacggaacccaatcgtagaacaggtggttatggagaccctacgcgtagtacgagacatctggcaatactacggcaacggcgccaaagacttcttttcagagatccacgtagagctgggccgcgaaatgaaaaacgacaaaaagacacgcgaacgaatcagcaagtcgatcacggagaatgagaataccaacgaaagaataaagaacatcctaaaagagctcatgggcgacgaggccctacaaggcgacatccgaccctactcaaaagggcaccaggacatcctaaagctgtacgaagaaggcgtattcgccaacgccccggagacgtacaaaaacataaaaatagacgacatcgagaagatacgcaagaacaactccccgagcaaaagcgacatcgtaaagtacaagctctggctcgagcagggctacatctccccctatacaggaagcccaatcccgctaagccgtctcttcaccacagactaccaaatagaacacatcatcccacgatcccgttacttcgacgacagcatgggcaacaagatcatatgcgaatctgcagtaaacgaagaaaagacaaataagaccgcatacgagttcatcaaagaaaatgccggacgcatcatcgacctaggccaaggaaaacaagtccccctcttcgacctcgaagcctacgaaagccactgccgcggctacttcaaaggcaacacaaagaaactaaaattcctcctcagtgaggacatcccagagggcttcatcaaccgacaactgaatgactcacgatacatctcgaaggtagtcacctcgctcctaagcaacgtcgtgcgcgaggaaggggaacaggaggcgacctcaaagaacttagtccccctagtcgggaccattacgagtaaacttaaaaaggactggggcctagaagctatctgggacgacctaattgcgccaaggttcgaacgtatgaaccagctcacaaaatcaaccgacttccggaaggaagtaatagacgggcacggcaatagatacttcataaacactgtccccgacgacataaagaaaggcttctccaagaaacggatcgaccataggcaccacgcgttagacgccctagtaatagcatgtaccacgaaagaccatgtcaactatatcacatccctcaacacccagcgcaataacagatctcttgtttcaaaactccgcaaaatcgaagagaagacaataaaggacaagcgcacaggacaacccaaaaccataaaaatcgcaaaggcttaccacaaaccatggcccaacttcacaaaagaaacctttgaaaaactctcgaaaacggtagttagcttcaaacaaaaccaacgcataataaacaagactaacaacaaaacctggggctgggagaaagtggatggcgtcatgaagaaagtactcaagaaacaagagaaaagaaactgggcaattcgcaaaccaatacacaaagaaacctactacggaaaagtcaaaggcttcgactcacccaagggcaagataacgacggccaccaggaaatcactccgcgagatcacaaacgagcgacagctcaacacaatcacagattctggcatcaagaaaatccttaacaaccacctcaaaacattcatagacgaatcaggtaaaataaacttcgaacccgccttcaaccaagacggaatcgacctcctaaacaagaacatacaacaactaaacgagggcaaaaaccaccagccaatatacaaagttcgcatgtacacccacaacactatgttctccgtaggcgacgaagggaacaaatcaacgaaatacgtcatacccgagtcgggaaccaacctattcttcaacgtttattgggacgaagaaaacaacaaaagaaacttcgaaactgtgcccctaaatagagtaatagcattccagaaacaaacatcgcacatccccagaaaggaccggacggacgttcctatagacaacacgctaggtcggttcctgttcaccctaagccccgacgacctcgtatacctcccaactgatgaggagagcgagagtttcacaaccttcgagatagactccctaaactcaaaacaggtggccaatatatataaattcgtggacggcagcggaacaacgggaaacttcgtacccgcagaagctgcccgagtcatcgccaacatcaaagacaagaaagtgcgaagcaacttctgcaaaagaaacaacctctccgacaaacaactcatcaaaaacgaatttggactggggtccccacagctgaaaaatcaaaatagcctcgacgggcggcaaataaagtccatatgctggaaactcgagatcaaccgcctcggcaaaataatcaaggtgataaagtga

SEQ ID NO: 6898 - RNA, 4515 nt, synthetic construct
  misc_feature 1..4515: note = Cas9 variant
  source 1..4515: mol_type = other RNA
atgaaaaaggtcctcggcctggatataggaacgaacagtgtcgggtgggcagtcgttaaccaaaacgacaaaggcgaatttctctcgatcgagaaaatcggatctcgaataatccccatgtcccaagacgtaatggacaaatttggcgccggacagacagaatctagcacagcacaacgcacacaatacaggggagtccgacgactacgcgaacgcagccttctaagacgcgagagactccacagggtgctacacatcctccacttcctcccccaacactacgacgcagcgataggttggaacaagaaagaaaataagacgtatgggaaattcctcccgggcgttgaggtaaacatcccgtgggtagcgacagaccaaggccaccaattcattttcatggactcgtatgcggaaatgctcaaggacctcaaacaacatcaaccccatctcttcgagaaaagctccacgccggttcccctcgactggactatctactacctacggaaaaaggccctgacacaggccatcagcaaagaagaactcgcatggattctcctaaacttcaaccagaaacgcggctactatcagctcagaggggaggaagtagaggataacaccaaacgggaagagttctacgcactcaaagtggttaaagtagaactcgacaaagacaacacatccgccaaaacatggtataaagtgcacctcgaaaacggattcatctacccgtgcccaagtgacacgccaatcgatagctgggtagggatggtcaaagattttattgtcaccacaacactggaaaaggacggaagcgaaaaacgaacagcagacggtgagatcaaaaggtccttccgtgcgcccaaggaggacgactggacactcctcaaaaagaaaaccgaaagcgaattagaaaagagcggcaagcaagtgggagccttcatatacgataccctactcagcaatcccgaccagaaaataataggaggtctcatcaaaacgatcgaacgaaagtactacaagaaggaactggagcaaatactcgagacacaacaaaaattcatagcagaactaagcgacaagaaattattccaggcctgcgcggaagaactctaccctctaaacgactcgcaccgtgaaaatttgctagaacgcgacttcaaacatctgttcgttcaggacataatattctaccaccgaccattaaagacaaagaaatccctcatctcgaactgcacctacgagtaccgaaccttctacaaaaacggagagaagcaaatctcgccaatcaagtgtatcgccaaaagcaacccactcttccaagagtttcgcgtgtggcaattcgtgcagaacctacgaatcctgcaacgacagcgatccgaaggcgacagcatcaaatacaacgtggacgtcaccgccgagttcctaaaagatgaaaacgatatagccaacctattcacatggctcaacgaacggaaggtaataaaacaagaccagctactcaaaagctattttaagctcaaagtcaacaaggaaaccaaagaactagactatagatggaattacgtggacgacaaaaacaaggaatacccttgcaatgccacccgaacccacatcctcagcttccttgaaaagtgcaaagaagaaaagagaatcgaagacgaccggttcgtatactcgctgtggcacttgttgtactcagtcgttgaacccatcgagctccgaggggccctcgccaaatttgccgaaagagaacacctacacccctctttcgtagacgtctttgcccagttcccgcccctagaaaaggaatacgggtcctactccgagaaggcgataaagcggctactcccactgatgcgaatgggcgactactggcacgaggacaaaatcgacgttaagacaaagcagcgtatacaacgcataatagacggggaagccgacgacgacataacccaccggtcgagggaaaaagtcgaaaacctgcgttccattacggactttaagggcctcccactatggaaagccggatacgtagtgtataaccgccactccgagagcggagaactcacaaaatggaaaactccccatgaactctccaactacatccaaaacgagttcaaacagtattcgctacgtaaccccattgtggaacaaatcgtcctagaaacactccgagtagtccacgacctttgggtaaaacacggagactttagcgaaatacacctggagctaggaagagacatcaaaaacagctcagacaagcgaaagcgcatggccgaacgtcaacaggagaacgaaaactcaagacaacgcgtcctagagatgttaatagacctcaagaaagaggcggcattcgcagacctcaacccctacagcccaagccagcaagagaaactcaggatcgtagaggacggagtacttaggtcaaacatcgaaatccccaaagacatcgagaaaataacgaaatcagcgaaaccaacctcccgcgaacttaccaaataccggctctggctcgaccaaaaatatcgaagcccatacaccggccaacccatatcacttgcacagctattcactagcaagtacgaaatcgaacacgtaatcccccaagctaagtactttgacgactcattcaccaataaagtcatctgtgaaagtgaagtgaacaaagaaaaaggatcaatgctcgctcatgagttcatcctaaagaacggtggttcaactgtaaacgtaggcggtcgacaggtccaagttctaaagaacgacgcgtacgtggaactgattaaccgcctatatggaaagaataacccagtgaaagcaaagaaactacttgcagaagacatagacgaagtcgtcggggacttctctgagcggcagctaaacgacacgcgatacatctcacgcgtcgtgcaaaaacttctgtccaacatagtacgtgaggaagatgagcaagaaagtacaagcaaacacgtcatcgggtgcagcggccaagtcaccacagcgctcaagaaggactggggcctgaatgatatatggaacaaaataatccagccgcgcttcgagcgcctcaacgagatgacagccacggaggactacggcgtctggcaaagccccaaccacttccaaatacgcgtaccagaagaaatccaaaagggctttaccaagaaacggatcgaccaccgccatcatgcaatggatgctctggtcatcgcgtgcgcaacccgcagtcacatcaactatatatcaaacagatctggccaggacaggaatgccaaattcgaaaccacgcgaaccgacctgcgctccaaactatgctataaagaaaacagctccggcaacaactacaactacatatttaacaaaccctgggacactttcacgcaagacgcccatcgggcgctcgagaacatagtggtctcacacaaacagaacctacgcgtcctgacgaagacgaacaattacacccagttcataaacaaagacggcaagaaggatctgcaaaaacaggtaaaaggagaccactttgcagttcgaaaacccatgcatcaagaaaccatctacggacgcgttagcatacgcagcataaaagaagtagcgctcaagaaagccctagaaaactggaaacaaatcgtagaccgaacgctaaaagataagatacgcgaactcatcggcgcatacggcaagtacgacgcacaaacaatcttgaaatatttcaaggaccgcgactataaatttaacaacctcaaaatcaacagagtagaggtctatgagtatgaccacaactgcgccgcagtcaggaagtcgatcggagacgatctaactataaaacaaatcgagcgcataaccgacgaatcgatacgtaaaatcctaatgaaccacctctcaaactacgacgacaacctcaaggaggcattttcccccgagggcttaatggaaatgaacaaaaacatcaaggagctcaacggaggcaaaaaccaccaacccatctacaaagtacgcctatttgaagacctcggaagcaagttcccactcggagttagccacaacaaccccgacaaatacgcaatcgctgcaaagggaaccaatctcttctttgggatctacgaagaccaagaaggaaaaagaatgttcgacagcatccccctcaacatcgtaattgacagactcaaggagaaaaagtctccagtgcccgagacctataacgagagcaaactcaagttccatctgtcacccaacgacctagtatacgtgccgactgacgaggagcaaaaacaacccgaacttgtagacgtggaccatctcagcgatgaacaaaagggccgcgtttacaaggcagtatcatttacaggcaatcgcgctttcttcgtcaaccacagggtaagcaaggtaatacacgactacgtagagttcggcacaaagaacaagatcgaaaacgacgacgacaaacgctccctcaaacacatctgctggaaactcaaggtgaaccgcctcggcgaaatcacggacgtgaaacgatga

SEQ ID NO: 6899 - RNA, 4515 nt, synthetic construct
  misc_feature 1..4515: note = Cas9 variant
  source 1..4515: mol_type = other RNA
atgaaaaacatcgtagggttggacctaggcaccaactccattggctgggccgtcgtaaacggatcggtaaacgacgacggttccgaacagctcgtgaagatccaagccagcggatcgcgcatcatcccaatggatgcggccatgatcggagacttcaacaaggggaacagcatcagtcagacagccgaacgaactcgactgcggggagtgcgtagactctccgaaagatacctcctacgccgcgaaaggctccatagaatcctcgacatactcggattcttaccgttccacttcgcccaggacctcgacagacacggaaaaattgtcaagggcaaagagccaaaactagcctggcggaagaacgaagcaggccaattcgagttcatcttccaagactccttcaaggaaatgctagaagacttcaagctaaactacccgaatctcataacagacgataagaaagtcccctacgactggaccatatactacctccgaaagaaaggactgacgagcaaaatatccaaagaagaattagcctggatcctcttaaacttcaatcaaaaacgcgggtactaccaactacgcggcgaagaagaggaggagaacaaggacaagctcgtcgagttctacgcacttaaagtagtagcggtagaagacagcggcgagaagaaaggaaaagacatctggtacaacgtgcacctagaaaacggatgggtataccggcgcacatccaacatgtctctagactgggtagggaaaaccaaagagttcatcgtaacgacggatctcgaaaaagacggcacaccaaagaaagacaaagaaggcaacgtgaagcgaagtttccgggcccccaaagaagacgactggtccctagtaaagaaaaagacggaagcggacatcgatcagacgcacaaaaccgtcggggcctacatttacgacactctcctaggcaaccccagtcaaaagatacgcgggcggctcgtacgcaccatcgaacgcaagtactacaaggaagaactcaaactgatcctagaaaagcagaaagagttccacctcgaattacaggatcgcgcgctctacgcagcctgcatcgaagaactctacccgatcaacgaagcccacaggaacaacgtaggcaaccgggattttacatacctgttcctggaggacattcttttctaccagaggccactcaaatcgaaaaagagcctcatcgacaactgcccgtacgaagaaaaccagggcctcgacaaagaaacgggggaaataaaatcatttcccgtgaaatgtattgccaaatcgcacccgctctttcaagagttccggctgtggcaattcattataaacctgagaatctaccggaaagacttagcccaggacgtagacgtcacaaacgaactactaaaaaccgaagaagattacgtagcactattcgactggctgaacgggaaaaaggaaatagaccaaaaagcgttcctcaaatacccagtattcgggctaaagaaagaaatagagaactaccggtggaactacgtacaggataaaccctacccctgcaacgagacccggtccctcatgctcgcacgcctcgagaaatgcgacataagtatcgagttcctaacaaaagaaaacgaagaagccttatggcatatactctatagtgtcgaagacaaaaacgaaatagtgaaagccttacaaaaatttgcggataaacacgacctaaacgccagcttcgtagacgtcttccaaaaattcccaccattcaagaaagaatacggcagctactccgcaaaagccataaagaaacttttaccactcatgcggatgggaaaatactggagcgaaaactcaatcgataagggaacccgcgaacgaattgacaaaataatcaccggagaatacgacgagaaaatcgaaaacagagtgcgggaaaaagcaatccacctagccgacgtgtcagactttaaaggactccccctctggcttgtatgttatatcgtgtatggcaggcactccgaggccaaggagatcatacaatggaaatcccctgcagacatagactcatacttgaggtccttcaaacagcactcactacgaaacccaatcgttgagcagataataatagaaaccctacgtgtggtccgcgacatctggaaacaagtaggcaacatagacgagatacatgtagagctaggccgcgaaatgaagaaccccgcagataagcgaaagaaaatgacgcaacagatgagcgaaaacgaaaacacgaacctaagaatcaaatacctactcaccgaatttctcaacccggagtatgaagttgaaaatgttagaccctactcaccatcccaacaagacatcctccgcatctacgaagaaggtgtcctcaacagcgtaagcgacctaccagaagagatatcggacatcctcaagaagttcaccgagacagatctcaagaaacgcccatcgcgctcagaggttctcaggtacaaactctggctcgagcaaaagtaccggagcccatacaccggcgaggtgataccgctcggtaaacttttcaccccggcatacgaaatcgaacacgtgataccacaatcgtattacttcgacgacagcttctcgaacaaggttatctgtgaagcagaagtcaataagctcaaaagcaacctcctggggcacgagttcatcgtaaaacaccacggggaaatcgtagaattacccttcggcaagaaagtccggattttcacagttgacgaatacgaacaattcgtaaaagacaactatagccgtacccgatccaaaatgaaaaagctactcatggacgacattcccgaagagttcgtcacccgacaactcaacgactcacggtacatctcaaaagtggtcaaaagcctcctgtccaatattgtacgagaaaagggggaagaagaggcaataagtaaaaacgtcattccctgcaccggcggcgtaactgaccgtctcaagaaagactggggcataaacgaagtatggaacaaaataatcctgccccgattccagagactgaacgaactaaccgggaccaacaaattcacgaccaaaaacgtcgggattcaggagattccgaccatgccactggagctacaaaagggattcaacaagaaacgaatagaccacaggcaccacgccatggacgcgataatcatcgcatgcgcaaacagaaacatcataaactacctcaataacaaatcagctaccgccaaggcagagctttcccggtacgacctacaaaagatgctctgcgacaaggccaagaccgacaacaacggcaactacaaatgggtcatacgaaaaccgtgggcgtcattcacacaagacacctatctagcactcgagaacataattgtctccttcaaacagaacttacgagtcatcaataaagctactaaccgcttcctccactacaacgaagaaggcaagaaaatattcgtaaagcagggaaagggagacaattgggcgataagaaaatccatgcacaaagacaccgtgttcggagaagtaaacctccggcgtatcaagaccgtagctctcaacgaagctatgaaaaacccccaatccatagtcgtcaaagacttcaagagaaaactcctagagctctggaacctcggtttcgacgccaaacgaatcaagaagtacttcgaggacaacagagaaacctggagcgatataaacctcagcaaaatagaggtctactatttttctaaagacactaaagaccgattctttgcgactcgaaaaccgctagatacctcattcgaccgcaagaaaatcgagaacaacatcaccgacacggggatacagaaaatcctcctccgccaccttgagctcaaggacaacaacccggatatcgccttcagcccggacggaatagacgagatgaaccgtaatattatccaacttaacaacggtaaataccatcaacccatcattaaaatcagatggtacgagcaagcggacaaattcgccgtaggacagaccggcaacaaaagcagcaagttcgtagaggcggcgaagggaacaaaccttttcttcgccgtctacgaaagcaacatcttagacaagaaaaccaataccataataaagaaacgtaactacgccaccattccactcaacgtggccatcgagcggcaaaaacagggtctacccgtcgcccccgaggatgagaacggcaacgacccaatcttcgttctgagcccgaatgacctcgtctacctccccacagacgatgaattagcgaatggcataatcgcccagcccctcgaccgaggacggatctacaaaatggtatccagctccggggagcaatgcttcttcataaaacacattgtagcaaacgtactcgtcgacaagttcgagttcagcccgctaaacaaaatggagcgagccctcacaggcgaaatgataaagatgatctgcatcccaatcaaagtagaccggctaggcaacgtgctggagtccagctcctcgtacaaaaagtga

SEQ ID NO: 6900 - RNA, 4515 nt, synthetic construct
  misc_feature 1..4515: note = Cas9 variant
  source 1..4515: mol_type = other RNA
atgaaaaacatagtcggcctagaccttggcacgaactctatcggctgggccgtggtcaacggatcagtaaacgacgacggttcggagcaattagtcaaaatacaagcaagcggatcgcgcatcatccccatggacgccgcgatgataggggacttcaacaaaggaaactcgatctcccagaccgccgaacgaacccgcctacgcggcgtaagacgcctaagcgagcgatatctcttacgacgagagcggctgcaccgcatcctcgacatcctaggctttctaccgttccactttgcacaagacctcgacaggcacggcaaaatagtgaaagggaaagaaccaaagctcgcatggcgcaaaaatgaagcaggccaattcgagttcatcttccaagactcattcaaagaaatgctagaagacttcaaacttaaccatcccaacctcataacggacgacaaaaaggtcccatatgactggaccatatactacctgcgaaagaaggggctcacaagcaaaatcagcaaggaagaacttgcctggatccttctcaatttcaaccaaaaacgcggatactaccagctccgaggagaagaggaagaggaaaacaaaaacaaactcgtagagttctatgctctcaaagtcgtagccgtcgaagactcaggcgaaaagaaagggaaggacatctggtacaacgtacatcttgagaacgggtgggtctacaggcgcacctccaacatgcccctggactgggtcggcaaaaccaaagagttcatcgtgacgactgacttagaaaaggacgggaccccgaaaaaggacaaggaaggcaacgttaaacggtccttcagagcgccgaaggaagacgattggtcactgctaaagaagaaaaccgaggcggacatcgaccaaacacacaaaaccgtcggcgtctacatctacgacacactgctcggtaaccccagtcagaagatacgcggccgcctagtcagaacaatcgaacgaaagtactacaaagaggaactaaaacaaatcttagagaaacaaaaagagttccatctagaactacaagaccgggcactatacgcggcatgcatagaagaactctaccccatcaatgaagcccaccgaaacaatgtgggtaaccgcgacttcacatacttattcttagaagacatcctgttctaccaacgacccctaaaaagtaaaaagtcactcatcgacaactgcccctacgaagaaaaccaaggattagacaaagagaccggcgaaataaagagcttcccagtaaaatgcatcgccaaaagccaccctttattccaggagttccgactctggcaattcatcgtaaacctacgcatctaccgcaaagacctggcccaagacgtcgacgtcaccaacgaacttctcaagacagaagaagactacgttgcccttttcgactggcttaacgggaaaaaggaaatcgaccaaaaggctttcctgaaataccccgtcttcggactcaagaaagaaatagaaaactaccgatggaattacgtccaagataaaccctacccttgtaacgaaacccgcagtctcatgcttgcaagactagaaaagtgtgacatatccatagagttcctaacaaaagaaaatgaagaggccctgtggcacatactctactccgtcgaggacaaaaatgaaatcgtcaaggccctccaaaagttcgcagacaagcacgacctaaacgcttctttcgtggatgtcttccagaaattcccaccgtttaagaaagagtacggctcctactcggcgaaagcaatcaagaaactattaccattgatgaggatgggcaagtactggtccgagaacagcatcgacaaagggacaagggaacgaatagacaagataatcaccggagagtacgacgagaagatcgagaaccgggttagagagaaggccatccacctggccgacgtatctgactttaagggactaccactttggctcgtctgctacattgtctacggacgacacagtgaggcgaaagaaataacccaatggaaatcaccagcggatatcgacagttaccttcgatccttcaaacaacactccctacgaaatcccattgtggagcagatcatcatagagacacttagagtagtcagggacatatggaagcaggtaggcaacatcgacgaaatccacgtcgaactaggacgcgaaatgaagaaccctgcggacaaacgaaagaaaatgacacaacaaatgagcgaaaacgaaaacacaaacctccgaatcaaatacctactcaccgagttcctcaacccggaatacgaggttgagaacgtgcgaccgtactccccaagccaacaagacatcctgcgaatatacgaagagggtgtacttaacagcgtctcagacctccctgaggagataagcgacatccttaagaaattcaccgaaaccgacctaaagaaacgaccgtccaggtcggaaatcctccgatataaactgtggctggagcagaaataccgtagcccctacacaggagaggtcatccccctagggaaactgttcactcccgcctacgagatcgagcacgtaatcccgcagagctgctacttcgacgactccttctcgaataaagtcatatgtgaggcagaggtcaacaaactaaaatcaaatctccttggccatgagttcatcgtcaaacaccatggcgaaatcgtagaattgcctttcggcaaaaaggtgcgcatattcaccgtagatgaatacgaacaattcgtcaaagacaactactcgcgtacccgaagcaaaatgaagaagctactcatggacgacatccccgaagagttcgttacccgccaactaaacgattcacgctacatcagcaaagtcgtgaagtcactcctaagcaacattgtccgtgagaagggagaagaggaggccatctccaagaacgtgataccatgcacgggaggggtcacagatcgcctaaagaaggactggggcataaacgaggtctggaacaaaataatccttccgcgcttccagcgcctcaacgaactcactggaacaaataaattcaccactaaaaacgttggaatccaggaaatccctaccatgccgctcgagctacagaaaggtttcaacaagaaacgcatcgaccaccggcaccacgccatggatgccatcatcatcgcctgtgccaaccgcaacatcataaactacttaaataatgagagtgcgaccgccaaagccgaacttagcagatacgacctacagaaaatgctatgcgacaaggccaaaaccgacaacaacggcaattacaaatgggtaattcgcaagccatgggcctcattcactcaagacacatatctagcacttgaaaatattattgtatcattcaaacaaaacttgcgagtcatcaacaaagccaccaatcgctttttacattacaatgaagaaggcaaaaagatattcgttaaacaaggaaagggtgataactgggccatacggaaatccatgcacaaagacaccgtattcggggaagtaaacctccgccgcatcaaaacggtagcattaaatgaagccatgaaaaacccccagtccatagtagtaaaggacttcaaaagaaaactactcgaactctggaacctgggcttcgacgcaaagaggatcaaaaagtatttcgaagacaaccgagagacctggtcagacataaacctgagcaaaatagaggtgtactatttctccaaggacaccaaagacaggttcttcgccacccgcaaacccctagacacgagcttcgaccggaaaaagatcgagaacaatataacagatacaggcatacagaaaatcctgctaagacacctggaactcaaagacaacaatcctgatatagcgttctcacccgatggtatagacgaaatgaaccgcaacatcatccaactgaacaacggaaaataccaccaacccatcataaaaataagatggtacgagcaagcagacaagttcgcagtcggacaaaccggcaacaaattctccaaattcgtcgaagcagcaaaagggaccaacttattcttcgccgtctacgagtccaacatactggacaagaagaccaacaccatcatcaagaaacgaaactacgcaaccatacccctcaacgtcgctatagaacgccaaaaacagggcttacctgttgcacccgaggacgaaaacggcaacgaccccatatttgttctcagtccgaacgatttggtctacctgccaacagatgacgaactggctaacggaatcatagcccaaccgctagaccgcggacggatctacaaaatggtctcatgcacaggcaacgaagggcacttcatccctgcaagaatcgccaacccgattctacaaacgatcgagctcggctccaacaacaaagcacaaaaggcgtggactgacgaaatgataaaagaaatctgtatgcccattaaagtagacagactggggaacgtactcgagtcctcgagctcctacaagaaatga

SEQ ID NO: 6901 - RNA, 4521 nt, synthetic construct
  misc_feature 1..4521: note = Cas9 variant
  source 1..4521: mol_type = other RNA
atgaaaacgattctaggcctcgacctaggcccaaacagcataggatgggctaaggtggaggtcgatgatgagggcaactaccttaggaacatcaaactcggttctcgaataataccaatgacgcaagatatgctcggagacttcgataagggcgtgaaggtatcacaaaccgcaatccggaccgacttccggggaaatagaagactaatagagcggcaccttctacgaagagagcgcttacaccgcgtacttcacgccctcaaattcctgccaaaacactacgaggacgctattggatgggacaggaacgaacctgctacatacggcaagttcgtcaataactcggaacccaagctagcatgggagcgacaggaggacggctccatgaggttcctattcatggagagcttcaatgaaatggtggcagatttcgcccagaatcaaccgtccctcgtatcggacggcaagaaaatcccgctcgattggacgatatactacctccgcaagaaagcattaacacgccctatcaagaaagaagaactcgcttggatcctactgaacttcaatcaaaagcgaggctattaccaactgcggggcgaagaagaagaagacaacctaacgaagcggaaggagtactataaacttaaggtggtcggagtcgaggcagacggcgcgccaaagggaggcaaaacttggtataacatccacctcgagaacggatggaccgcacggtgtcagagcaaaatccccctcgacgactgggtgggcaaggtcaaagagtacattgtcacaacagaatatgaagacgacggcaaaaccccgaaatgcgacaaggaaggcaaggtcaaacggtccttcaagtcaccggaaaaggacgactggcagctcatcaaaacccgcactgaaaagttcatagacgactccaataaaacggttggcgccttcatctatgactacctattggaaaagcccttcgacaaaatacgaggcaagtacatccgcacgatagaacgaaagtactacaaaaacgaactacgagaaatcttaagagaacagaccaaataccacgaagggctacactcactagaggcactgaaaatctgtgcagaggagctctacaaaaacaatcagcagcaccaagaatacctgctaaagaaagacatgacgttcctactgcttaacgacctgattttctaccaacgcccgctcaagagcaagaaaagcctcatcgcggactgcccctacgaagtctacaaatacgacgacaaactcacaggaaagaaagggcaaaagaaaatcaaatgcattgcgaaatccaacccgtactaccaagagttcagactgtggcagttcatcgcgaacctccgactgttcagcgtcaccgatggcaaagaagtcacagcggaatatctcaaaaccgaggaggactacgtccgcctattctcattcctaaacgacagaaaagacattaagcaggaaacctttctccgcagcttccttaaacttaagaaggaaagcatcggctccgaaaagatctaccccatacgctggaactacattgaagacgcaaataaaagctacccatgcaatgcgaccagacacgaactgctcctcgccttcgaccgtgcagacatcccccgagagctcctcgacgtagaagaaagggagtaccgcctatggcacctactgtacagcatcgaagcgaaggaagaaacggaatcagcccttcgaaagttaaaggccaacaaagcgttcggggacctaaacatcgacgatgcgttcgttaacagctttctcaaaataaaaccgttcgaaaaagagtacggagcatacagcgaaaaagccatcaagaaactcctagccgtcatgcgccgcggttccctctggaaagaggcagatatctgcgaagcgacaaaacaaaacatcgccaagatcctccagaacgacatagacgaaaagctaaagaagaaaatcgaagccgcagtcagcagtttcaacaaactatcagactttcaaggtctcccaacatggctggcctgttacgtcgtatatggcagacacagcgaagccgcccagatacaatgctggcaatcacccgaagacctcaaaacttacatcaacaaattcaagcagcatagcctacggaacccgatagtcgaacaatgcctcctcgagacactgcgcacagtatacgacatctggaaagatgcgggccagattgacgaaatacatatagaattggggcgcaacatgaagtcaactgccgaacaacgcgcaagaaagactaaagacatcttgcgtaacgaaaacaccaacctccgaattaaaaatctcctagtcgagttgaagaacgacgacaaaatcgagaacgtgcgaccatacagcccgagccaacaggagatcctcaggatctacgaggaaggcgctctccaagagctgagcaaggaagacgaaatgttcgaggacatctccaaaatatcaaaaatggctcagccatcaccgacagaactcagtcggtacaagctctggctcgaacaaaagtacagatcgccctacacaggcagagttatcccgctttccaaactgtttaccacggcataccaaatcgaacacataatcccacagtcccgctacttcgacgatagcttcaacaacaaggtcatttgcgaaagcgaagtcaactcactcaaagacaacatgttgggatacgagttcatcaaagaatgcggcggccgcatcgtccactgcacgctcctcggcgatgtcaaaatcttcactaaagaagaatacaaagacttcgtgacgaaacattacattgacaacacatacaaacgagacaaactcctcctcgaagacataccccaagagttctccgcccgacaactgaacgactcccgttatatcagcaagatggtccaaaccgttctctcaaacatagtccgcgccgaaaacgaacaagaagccacctcaaaattcgtcgtttcctgcaacggagcgatcaccaaccggctaaagaaagactggggattgaatgacgtatggagttcaatagtttgcccacgattcaaacgacttaatgaaataaccaaaaccaacgccttcggacactgggaagacaaagcaggaaaacacgtattccaaacgaccgtgccccttgaactacaacgcgggttcagcaaaaagcgcatagaccaccgccatcacgccatggacgccctagtaatagcctgcgcctcacgaaacatcgtcaactacctcaacaacgagtccgcaaactcaccagagaaacgagaggacctgcgcaagaaactatgcgacgagaaaagaaagatccgaaaaccatggaagacattcacacaagacgcacgagaagctctatcggacgtcgtcgtatcatttaagaactatgtaagagtgatcaataaggcaaccaactactacgaacactactccagctcaggcaacaaagtaatgataagccaaaagggcaacgatatgtgggcaatccgcaaaccacttcacaaggaaagcgtctttggcagggtaaacctctgtcgaaaagtcatagtctccctcaagaaagccctagaaaacataccggcaatctgtgataaaacattacgcgactatatcaacgcgctagtcgagaagcacttcaacacgcgacagctgctagcccatttcaaatccataaactaccgcttaaaccgacagtgcgtcgagaaagtggaagtatggcagttctcagacgagaaaatcgaaatggtagcccgaaggaaatccctagacaccagcttcgacgacaaacaaatatccagtataacggataccggcattcaaaagatcttactaaactatttacaaaccaaagacggcaatgctgaaatagcgttcactcccgaggggatagaagaaatgaacaaaaacatctctctatataatgacgggaaagcccaccaaccaatcttgaaagtccgcgtagcgacacccaaaggtatgaaataccccgtaggacaaaccggcaacaaagcaacaaaattcgtcgttgccgaaaaaggcacgaacctatactttgcgatctacgagaacgaactcggagtccgctcatatgacactatcccattaaacatcgtggtcgagcgactaaaagaaggcctgagcccggtcccccaagccaacgaagcggacatccccttgaagttctaccttagcccaaacgacctggtatacgtaccaacaaaagaaaacgaagacgagctttgccgcgaccgaatatacaaattcgtcgattcatctggcaccaccgccaactttgttccgcacacatccgctaacaccatatacaacgtggacaaagaatatgccgagaaatgttgtaacggagcagtcttcttgaacgagtacggcctcgggagcccgcaatccaagaaccagagggccttaacaggggaaatgataaaggaaatatgctggaagttaaaagttgaccggctcggaaacatcatcaaagtcatcaaatga

SEQ ID NO: 6902 - RNA, 4530 nt, synthetic construct
  misc_feature 1..4530: note = Cas9 variant
  source 1..4530: mol_type = other RNA
atgaaaaatattgtagggttggatctcgggacgaatagcataggatgggccgtggtaaacgggtcggtgaacgacgacggtagcgaacaacttgtcaaaatacaggcaagcggttcacgtataatacccatggacgcggccatgataggcgatttcaacaaaggaaactcaatcagccaaacggcagaacgaacccgcctccgaggggtccgtcggctcagcgagcgatacctactccggcgagaaaggctccaccgcattctcgatatactgggcttcctcccattccacttcgcccaggacctagacagacacggaaaaatcgtaaagggaaaggaacccaagctcgcatggcgaaagaacgaggccggccagttcgagttcatattccaggacagcttcaaagaaatgctggaagacttcaaactcaaccaccccaatctgatcaccgacgacaagaaggtaccctacgactggactatctactacctccgcaagaaaggtctcacctctaaaatctccaaagaagaactcgcgtggatacttctcaatttcaaccaaaagcggggatactaccaactccgcggggaagaggagaaaaagaacgacaacgtaatgataatcaattcaaaagtcatcgatgtcgtaaaggcggaaaaagataagaaatacgagaaatactggtacaacgtactactcgaaaacggtctgctataccgggcagccttctataacgacatatcattctggaaaggccatactaaagaatttgtcctaaaaacgataaaactaaaaagtgggggcacgaaacaagagctttcattcctaccgtccttcgacgaaatcgagaaaatggaaaagaaacaaaaggacaaaatgtacttcaaaataaaactcaagacagaagccgatatcgaccaagcccacaaaacggttggaacctacatctacgacacgctactcggtaacccctcacagaaaatacggggaaggctggtcaggaccatcgagcggaaatactacaaagaggaactaaaactgatactggacaaacagaaggagttccatcccgaactacaggaccgagccctatatgcggcatgcattgaggaactataccccatcaatgaggcccaccgcaataatgtgggaaaccgcgacttcacatatctattcctagaggacatactcttctaccaacgacccctaaagtccaaaaagagcctgatcgacaactgcccatacgaagagaaccagggactagacaaagagacaggcgaaatcaagagcttccccgttaaatgcatagccaaatcgcaccccctattccaggagttccggttgtggcaattcatagtaaacctacgcatttaccgcaaagacctagcacaggatgttgatgtgaccaacgaattactcaaaactgaagaagattatgtagcccttttcgactggcttaacggaaagaaagagatcgatcaaaaagcgttcctgaaatacccagtatttggcctaaagaaagaaattgagaactacagatggaactatgtacaggacaaaccgtacccctgcaatgaaacacggctactcatgctcgcaagactggaaaaatgcgacatctctatcgagttcctaaccaaagagaacgaggaagccctatggcacatactctacagcgtcgaagacaaaaacgaaatcgtaaaagcccttcagaaattcgcggacaagcacgacctcaacgcctccttcgtagacgtcttccgaaagtttcccccattcaaaaaggaatatggcagttattctgccaaggcgataaagaaacttctacccctaatgcgtatgggcaaatactggagcgaggactccatcgacaagggtaccagaaagcgcatggacaaaataataacaggcgaatacgacgaaaagatcgaaaaccgggtaagagaaaaagtgatacacctcgccgatgtctcagattttcggggactcccactgtggctagtctgctacattgtctacggccgccactcggaagcaaaggaaataacccagtggaaaagccccgcggacatcgacagctacctaaaatcgttcaaacaacactcgctgcgaaaccccatagtcgagcagataataattgaaaccctccgcgtcgttcgggacatctggaaacaagtgggcaacatagacgaaatacacgttgagctcggcagagaaatgaagaacccggcggataagaggaagaaaatgacacagcaaatgagcgagaacgaaaacaccaacctgcgaatcaaatacctcctcaccgagttcctcaacccggaatacgaagtcgaaaacgtcagaccctacagccccagccaacaagacatactacggatctatgaagaaggagtccttaacagcgtctcagacctaccagaggaaatctcagacatcctaaagaaattcaccgagaccgacctcaagaaacgcccctctcggtccgaaatcctccgttacaaactctggctagagcagaagtaccgcagcccctatacgggagaagtaatacccctcggcaaactcttcactcccgcctacgaaatagaacacgtcatcccccagagctgctacttcgatgactcattcagcaacaaggtaatatgcgaggccgaggtaaataaactaaaaagcaatctcctcggccacgagtttatcgtcaagcaccacggggaaatcgtggagctccccttcggcaagaaagtacgaatttttaccgtggacgaatatgagcaattcgtgaaggataactactcgaggacacgcgggaaaatgaagaaactactaatggacgacatacccgaagagttcgtagcccgacaactgaacgactcacgttacatctcaaaagttgtgaaatccctcctatcaaacatcgtccgcgaaaaaggggaagaagaggcaatctccaaaaacgtaatcccgtgtaccggcggggtgacagaccgactaaagaaagactggggcatcaacgaggtctggaacaaaataatcctcccccgcttccagcgcctaaatgagctcacgggcacgaataaattcaccaccaaaaacgttggcatacaagaaatccccacaatgccactcgaattacagaaaggctttaacaagaaaagaatagaccatagacaccacgcaatggacgcaatcatcattgcctgcgcaaaccggaacatcataaattacctcaacaacgagagcgccaccgcgaaagctgagctctccagatacgacctacaaaaactgctctgcgacaaagcaaaaacggacaacaacggaaactacaaatgggtgatccgcaaaccctgggctagcttcacgcaagacacgtacctcgcactggaaaacatcatcgtcagcttcaaacaaaatctgcgtgtaataaataaagccacaaaccgatttctccattacaacgaggaagggaaaaagatcttcgtcaaacagggcaaaggtgacaactgggccatccgcaaaagcatgcacaaagataccgtctttggcgaggtgaacctgaggaggatcaaaactgttgcgctgaacgaagccatgaagaacccccagtccatcgttgtgaaagacttcaaacggaaactcctcgagctctggaacctcggcttcgacgccaagcgaatcaagaaatacttcgaagacaacagggagacctggtcagacataaacctgtccaaaatcgaagtctattactttagcaaagacaccaaggaccgcttcttcgcaacaagaaaacccctggacacaagtttcgacaggaagaaaattgaaaacaacattaccgacaccggcattcaaaagatcctgctgaggcacctcgaattgaaagacaacaacccagacatagccttctcacccgacggaatagacgaaatgaaccgcaacattatacagctcaacaacggtaaataccaccaaccaatcataaaaataagatggtacgaacaagcggacaaattcgccgtgggccagactgggaataaattcagcaaattcgtcgaagcagccaaaggcacaaacctattctttgccgtctacgaatcgaacattctcgacaaaaagacgaacacaatcataaagaaacgcaactacgcaacgatccccctcaatgtagccatcgaacgccagaaacaagggctcccagtcgcccccgaagacgagaacggaaacgacccaatattcgtactttccccaaacgacctagtctatctcccgacagatgacgaactagcaaacggcatcatagcgcaaccgctagacaggggccgaatatacaagatggtaagctgcacgggcaacgagggacactttatccccgcccgcattgcaaaccccatcctacaaacgattgagctaggcagtaacaacaaggcccaaaaagcctggaccgacgaaatgataaaagaaatctgcatgccaataaaagtggaccggctggggaacgtcctagaaagctcctccagctacaagaaatga

SEQ ID NO: 6903 - RNA, 4530 nt, synthetic construct
  misc_feature 1..4530: note = Cas9 variant
  source 1..4530: mol_type = other RNA
atgaagcggattctgggcctagacctggggacgaactcaatagggtggtcactcatcgagcacgacttcaaaaacaaacaaggccaaatcgaaggactgggcgtccgaatcatacccatgtcacaagagatcctaggaaaattcgacgccggccaaagtatatctcagaccgcggacaggacgaaatacaggggcgtgagacggctctatcaacgcgacaacctacgtcgagaacgactccacagggtactaaaaatcctggacttcctacccaagcactactcagagagcatagacttccaagataaagtaggccaattcaaacccaaacaggaagtcaaactcaactaccgcaagaacgaaaagaataaacacgagttcgtcttcatgaacagcttcatcgaaatggtatccgagtttaagaatgcgcaacctgagctgttctacaataaaggcaacggcgaagaaacaaagatcccatacgattggaccctctactaccttaggaagaaagccctaacacaacagataacgaaagaggagctcgcatggctgattctcaactttaatcagaaacgcggctactaccagctccgtggcgaggacatagatgaagacaaaaataagaaatacatgcagctcaaagtaaacaacctgatagatagcggagccaaagtcaaaggcaaggtgctctacaacgtaatatttgataacggatggaagtacgagaagcaaatcgtaaacaaggacgagtgggaaggccgaaccaaggagttcataatcacgacgaagaccctcaaaaacggcaacataaagcgcacgtacaaagccgttgactccgaaatcgactgggcagcaataaaggcaaaaactgaacaggacatcaacaaggcaaataaaaccgtaggcgaatacatatacgaaagcctactagacaacccatcgcagaaaatccgagggaagctcgtaaaaacgatcgagcgcaagttctataaagaggagttcgaaaaactcctcagcaaacaaattgaattacaacccgaactcttcaacgaatcactctacaaagcatgcataaaagaactgtacccacgaaacgaaaaccaccagtccaacaacaaaaagcaaggattcgaatacctattcaccgaagacatcatcttctaccaacgcccgttgaaatcgcagaaaagcaacataagcggatgtcaattcgaacataaaatatacaaacaaaagaataagaaaaccggcaaactcgagctgatcaaagagcccatcaaaactatatcacgttcgcacccactcttccaagagttccgcatctggcagtggctacaaaacctaaaaatatacaacaaagagaaaatagaaaacggcaaactcgaagacgtcacaacgcaactccttccgaacaatgaggcctacgtgaccctattcgacttcctcaacaccaagaaagagctagagcaaaaacagttcatagaatatttcgtcaaaaagaaactcatagacaagaaagaaaaagaacatttcagatggaacttcgtagaagacaagaaataccccttcagcgaaaccagagcccaattcctaagccggctcgctaaagtaaaaggcatcaaaaataccgaagacttcctcaacaaaaacacccaagtaggctctaaagaaaactccccgttcataaaaaggatcgagcaattatggcacatcatatacagcgttagcgacctaaaagaatacgaaaaagcactcgaaaagttcgcagaaaagcacaacctagaaaaggattcgtttctcaaaaacttcaagaagttcccacccttcgtgtcagactacgcatcctacagcaagaaagcgatctcaaaactcctccccatcatgcgcatgggcaaatactggtccgagagcgcagtacccacccaagtcaaagagcgaagcctgtcaataatggaaagggtgaaagtactaccactgaaagagggctactcggacaaagaccttgcggacctcctctcacgcgtcagtgacgatgacattcccaagcaactgatcaaatcctttatttctttcaaagacaaaaacccacttaagggactaaacacgtaccaagccaactacctggtttacggccgacacagcgaaactggggacatacagcattggaaaaccccggaggacatcgaccggtacctaaacaacttcaaacaacattctctccgcaaccccattgtcgagcaggtcgtcatggaaaccctacgggtagtacgagacatctgggaacactacggcaacaacgaaaaggacttcttcaaagaaatccacgtagagctcggccgagagatgaaatcccccgccggtaagcgcgaaaaactctcacagcgcaatacagagaacgaaaacacgaatcaccggatccgtgaagtactaaaagaactgatgaacgatgcatccgtcgagggcggcgttagagactactccccgtctcagcaagagatcctgaaactatatgaagaggggatctatcaaaaccccaacacaaactacctaaaagtggacgaagatgagatcctaaagatcagaaagaaaaacaatccgacacaaaaagagatacaacgctacaaactgtggctagaacaaggatatatatctccatacaccggaaagatcatcccactcaccaagctattcacccacgagtaccaaattgagcacatcataccacaatctcgctactacgataacagcctgggcaacaagatcatctgtgaaagcgaagttaacgaagacaaagacaacaaaaccgcctacgaatacctaaaggtagaaaaggggtcaatagtgttcggccacaaactcctcaacctagacgaatacgaggcccacgttaacaagtacttcaaaaagaacaaaaccaagctcaaaaacctcctgtccgaagacatcccagaagggttcatcaacagacagctaaacgattcgcgctacatctcgaagctggttaagggcctgttgtccaatatagtccgagaaaatggggaacaggaggcgacgagcaagaacctcatccctgtaaccggggtagtcaccagcaagctgaaacaagactggggactgaatgacaaatggaacgaaatcattgcaccgcgctttaagcgattaaataaactcaccaattcaaacgacttcggtttctgggacaacgacatcaacgcatttcgaatacaagttccagactcgctcattaagggcttctcgaaaaagcgaatagaccaccgccaccatgcgttggacgcgctagtcgtcgcctgcacgagccgcaaccacacgcattacctgtcggccctcaatgcggagaacaagaactattcactccgcgacaagctagtcatcaaaaatgaaaacggtgactacacgaaaacgttccaaatcccctggcagggattcaccatagaggcgaaaaacaacctagagaaaacagtagtctccttcaagaaaaacctgcgggttataaataaaaccaacaacaaattctggagctacaaagacgagaatggcaacttaaacctcggcaaagacggtaaacccaaaaagaaactacgcaaacaaaccaaaggctacaactgggccattcggaaacccctgcacaaagaaacggtctccgggatctacaacatcaacgcgcctaaaaacaaaatcgctacctccgtaagaaccctgctgaccgaaatcaaaaacgagaagcacctagcaaaaatcacagacctcaggatcagagagaccatcctgccaaaccatctgaaacactacctaaacaataaaggcgaagcgaacttcagcgaggccttctcgcagggcggcatcgaagatctaaacaagaaaatcacaactctaaacgagggaaagaaacaccaacctatctaccgcgtcaaaatcttcgaggtagggagcaaattcagcatatccgaagatgagaacagcgccaaatcgaagaaatacgtcgaggccgccaaagggaccaaccttttcttcgccatctacctcgatgaagaaaacaagaaaagaaactatgagacaataccactcaacgaagtcataacccaccagaaacaggtagcaggcttcccgaagtcagaacgtctatcagtacagccggactcgcaaaagggcacgttcctgttcacactatccccaaacgatctagtatatgtgcctaacaacgaagaactagaaaatagagatctctttaacctaggaaacctgaatgtggaacaaatcagtcggatatacaagttcacggacagttcggacaaaacttgcaacttcatcccatttcaagtatcgaaactaatattcaacttgaaaaagaaagagcaaaagaaactcgacgtggacttcatcatacaaaacgagttcggacttggctcgccacaaagcaagaaccaaaaatcgatagacgacgtgatgatcaaagaaaaatgtataaaactaaaaatagacagactcgggaacatctccaaagcctga

SEQ ID NO: 6904 - RNA, 4530 nt, synthetic construct
  misc_feature 1..4530: note = Cas9 variant
  source 1..4530: mol_type = other RNA
atgaagaccatactagggctagacctcggcaccaatagcgtaggctgggccgtcatcaacagcgtcatcaaagaacaagcagaaagaatttggatagaaatggccggcagccgaatcataccaatggacgcggcagtgctgggggacttcgacaaagggaacagcatcagtcagacgagcgagcggacccgcctccgcggagttcgccgactacgagagagacagttactaaggcgagaaagactccataaagtcctgaacattctagggtttctgcccaaccactacctagaatatatagacttcgaaaagcacccagggaagttcctgagcgacgctgaacctaaacttccttgggtgaaagacgagcaaggtaagtacacattcctcttccaagcagcgttcgacgagatgctagcagacttcgcgatacaccaaccgtctcttgtcagtggagacaagaaaataccatatgattggaccatatactacctccgaaagaaagcactaacggagatgatcagcaaagaggaactagcctggatactcctcaatttcaaccagaaacgcggatactaccaactgcgcggagaggaagaagaagacaacgcaggaaaaagcgtggagttctacgcactgaaagtcctaaccgtagaagcaactgatgagaaaaagggacgcgacgtctggtataacgtccacctcgaaaacggctggatctaccgacgatcttccagtgtacccctggactgggaagggcagatcaaagagttcatagttaccacagacctcaatccagactcgacccccaagctggacaaatacggggaagtgaaacgcagcttccgagcgcccaaagaagacgactggatgttgatcaagaaacgaacagaagccgacatcgcaaacacccacaaaacagtgggagcttacatatacgacacactactgcagaaaccgcaacagaaaatcataggtaagttagtaaaaaccgtagaacgaaaattataccgcgacgaactatcactaatcctccaaaagcaatgcgcattccacgccgaactccaggatcgaactctctacgcacgctgtgtcgaagccctgtacccaaacaacgaagttcaacggaggaacatcgccaaccgcgacttcgtctatctgctgatggacgatgtcctgttctaccagcgcccgctgaaaacgaagaaaagcctcatcgccaactgcccatacgaagaaaacgagtacgtcgaccgggagactggcgaaatcaagaaagcgccgctcaaatgcatagcgaaaagccatcccctttttcaagagttccgcctgtggaacttcttaagcaacattcggatctaccaaaaagaaaaggagatcaacggcacactccacttggacgtggacgtcaccgcggaatttctcaagaccgaggacgactatgttgccctcttcgattggctgaactcccgaaaagaaatagagcagaagaccttcctgaaataccctaagttcggcctgaagaaagaaatatcaaactatcgctggaactacgttgaagacaaacaatacccctgcaacgaaacacgccatgcgatcttatctcgccttgagaaagctaacgtctgcatagatttcctcagcaacgaaaaagaagtcgccctctggcacatcctctacagcgtctccgacaaacaagagatcgaaaaggctctccgtacctttgcggctaagaacgggctcgacgaatcgttcgtcgaagcgttcaagaaattcccaccgttcaaatcggaatatggggcttatagcgcgaaagccataaagaaattgctcccgctcatgcgatgcgggaaatactgggacgtaagctcgatcgacgacacaaccaaagagcggatcaagaaaatagtcgcaggagagtacgacgagcgcatcgcggtaaaagtcagagacaaagtaatgaacctcagcgatataagctgcttcaaacgccttcccctatggctagcatgctatatagtgtacaaccgacacagcgaggacaaagaggctgttaagtgggagagtccggccgatatcgacgcatacctcgcgtccttcaagcagcactccttgcggaacccgatagtagaacaagttataaccgaaactttaagagttgtccgggacatatggaagcaggtcggacgaatcgacgaaatccacattgaacttggaagggaaatgaaaaacccagccgacaaacgcaaacggatgaccgcgcagatcctagaaaacgaaaacgcaaacctacgaattaaggcactactcgctgagttcatgaaccccgaatacgaaatcgagaacgtacggccctacagtccctcacaacaggaaatactccgaatctacgaggacatggtgctacacgcagaggaccagctcccagaagaaattgacgccattctaaagaagttcaacagctcgaaagtaccaacaaaaagcgagttcctaaggtacaagctatggctagaacaaaaataccgctccccgtacacaggagagctcatcccactaggcaaactattcaccgcagcatacgaaatcgaacacgtgataccgcaaagcagatacttcgacgactccttctccaacaaagtaatatgcgaatctgcagtgaacaaactcaaggacaaccagttgggatatgagttcatcaaaaaccatcacggacaaaaggtagaggtagggtttggaaagtcagtagagatattttcagtagacagctacgaaagattcgtcaaggaacaatacgccaaaagcgccgtgaaaatgaagaaaatgctgatggacgacatccccgaacagttcatcgaacgtcagctcaacgactcaagatacatcagcaaagtcatcaaagggctgttgtccaacattgtccgtgagaagaacgacagtggcgaatacgaaccagaggccgtgagcaagaacatagtcgtctgtaccggctcagtgaccgaccgcctcaaaagggactggggtatgaatgacgtgtggaactcaatcgtatacccccgattcgaaaggctcaattcactcacagacacccaatccttcggccactgggaaaacaagtccggcaaaaaggtcttccaaacggaactcccgctcgaataccaaaaaggcttttctaaaaagcgtatagaccaccgccatcacgccatggacgcgatagtaatagcatgtgctactcgaaaccacgtcaactacctttcaaatgaatccgcatcccggaacgccaaaatcagccgctacgacctgcaaaggcttctgtgcgacaaatccaggacggacgacaacggcaactacaagtgggtaatcaagaaaccctgggacacgtttacacaagacgcccgcgaagtgctatccaaaatagtagtgtctctcaaacagaacctcagaataatcaacaaaacaacaaacgtatacagacacctagacgcaaccggcaaccgcgtctacgagaaacaaaagaccggggactcatgggccattcggaaacccatgcacaaggacaccgtattcggcgccgtgaatctaagaaaagtaaaagtcgtccggctctcagtagccctagacgcgccgacaatgatagtcgacaaacgggtcaaaaataaagtatttgaactcctcagctacaagtacgataagaaacgaatagaaaagtacttcaaagagaacgccgtcctctggaaagaacttgaccttgcacgagttgcggtctattacttcacggaagccaccaccgaacccctagtagcagtccgcaaaccactagatagcaccttcaacgagaaaaagataaaggagtccgtaacagacaccggaatacagaaaatattactaaaccacttatgcactaaggaggggaaaccagatctagcattcagcgcggaaggcatagaggagatgaatcggaatctcctccaactgaacaatggaaagcgtcaccaaccgatatacaaagtacgagtctacgaaccgcggggcaacaagttctccgttggggtactaggaaacaaaggcacgaagtgggtcgaagcagcaaaaggtacaaaccttttctttgccatctacatcacggaagacggcaaaaggacatacgagacaatcccgttaaacatggtgatcgagagagaaaagcaaggactcgcgcccgtgcccgacaaaaacgaaaagggggacaagctactcttctggttaagccccaacgacctcgtctacctccccaccgaagaggaactggaatttggccgcataaatgaacccatcgaccgaggtcggatctacaagatggtaagctccagcggcaaccaatgcttcttcataccacaaagcatcagtaacgccatcatacccacgaaagaactcggcgcgaacaacaaggccgagcggagctgggacggcgcaatgatcaaaaatatatgcataccagtcaaagtggaccgactagggaggataatcgaagtaaaatacagaatcaacgaatga

SEQ ID NO: 6905 - RNA, 4530 nt, synthetic construct
  misc_feature 1..4530: note = Cas9 variant
  source 1..4530: mol_type = other RNA
atgaagactatactcggactagacctcggcaccaatagcgtaggatgggctgtcataaactcagtcatcaaggaacaggcagaacgcatctggatagagatggccggctcacgcataattccaatggacgcagcagtcctcggggacttcgacaaaggcaactctatctctcagacgtcagaaagaacccgactccgaggcgcgcgccgcctgcgcgaacgccaattactcagacgcgagcgtctccacaaagtgctaaacatcctaggtttcctccccaaccactacctcgaatacatcgacttcgaaaagcaccccgggaagttcctagcggacgccgaaccaaagctagcctgggtaaaagacgaacagggtaaatacacattcctcttccaagccgcattcgacgaaatgctagccgacttcgcaattcaccaaccaagcctagtctcaggcgacaagaaaataccctacgactggacaatctactacctacggaagaaagcactcacggaaatgatatcaaaagaggaactcgcatggatactcctcaattttaaccaaaagcgtggatattaccaactccgcggagaagaggaagaagataatgcaggcaagtcggtcgagttctacgccctcaaagtcctaacggtcgaagcgacagacgaaaagaaaggaagggacgtatggtacaatgtacacctggaaaatggctggatctaccgccgctcctcctccgtgccactcgattgggaaggccaggtaaaagagttcatcgtaaccacggaccttaacccagacggtacaccaaagctagacaaatacggagaagtaaaacgatccttccgagcacccaaggaagacgactggatgctaatcaagaaacggaccgaggccgacatagcaaatacgcacaaaacggtcggggcctacatatacgacacactactccaaaaaccccaacagaaaatcatcggcaaacttgtaaaaaccgtagagcgaaaactctaccgggacgagctcagcctcatcctacaaaaacaatgcgctttccacgcagaactgcaggacagagcactctacgcacggtgcgtcgaagccctgtacccctccaacgaagtccgccgcaagaacatagcaaaccgcgacttcgtctacttactcatggacgacatactcttctaccagcgaccgctcaagacaaagaagtcgctcatagccaactgcccatacgaggagaacgagtatgtagacagggagacgggagaaattaagaaaacaccactaaaatgcatagcaaagagccaccccctattccaggaatttcgactatggaacttccttagtaacatacgaatataccagaaagaaaaagagatcaacggcacactccaccttgatgtagacgtaaccgccgaatttctcaagaccgaagacgattacgtcgcgctattcgactggctaaattctagaaaagaaatagaacagaaaaccttcctaaaataccccaaattcgggctaaagaaggaaatatccaactacagatggaactacgtagaagacaaacaatacccatgtaacgaaacaagacatgccatcctatcatcactcgaaaaagccaacgtctgcatcgacttcctgtcaaacgaaaaagaagtcgcgctctggcacatactgtacagtgtaagcgacaagcaagaaatcgagaaagcactccgtacgttcgctgcgaaaaacggcctcgacgagtcattcgtcgaggcttttaagaaattcccgcccttcaaatcggaatacggcgcgtactcagccaaagccataaagaaaatgctcccactaatgcgatgcggcaagtactgggacgtgtcatcaatcgacgacacaacaaaagaaagaataaagaaaatagttacaggcgagtacgacgaacggatatctgtcaaagtgcgcgacaaagtcatgaacctcagcgacatctcctgcttcagaaggctacccctatggctagcgtgttatatcgtgtataatcgccactcagaagacaaagaagcggtgaaatgggaaagcccagccgatatagacgcatatctagcatccttcaaacaacactcactgcgtaacccaatagtcgagcaagtgataacagaaaccctccgcgtagtacgggacatctggaaacaggtcggacgcatagacgaaatacacattgaactaggacgagaaatgaaaaacccggccgacaaacgcaaacgtatgacggcacaaattttggagaacgagaacgccaacctccgaataaaagcactactagccgagttcatgaacccggagtacgagatcgaaaacgttagaccatactccccgagccagcaagaaatcctacgcatatacgaagacacagtcctccacgcggaagaccagctaccagaagaaatagacgcaatcttaaagaaattcaatagctctaaagtcccaacgaaaagcgagttcctcaggtacaaactttggctagaacaaaaataccgttccccatacaccggagaactgataccgctcggcaaactcttcacagcggcttacgaaatcgaacacgtcataccccaatccaggtacttcgacgacagtttttccaataaggttatctgcgaaagcgccgtaaacaagttgaaagacaaccagctcggctacgagttcatcaagaaccaccacggacaaaaagtcgaagttgggttcgggaaatccgttgagatattctcggtggactcctacgagagattcgtcaaggagcaatacgccaaaagcgccgtcaaaatgaagaaactcctcatggatgacataccagaacaattcatagaacgccaactgaatgatagccgctacatcagtaaggtcatcaaaggcctcctgtcaaacatagtccgcgagaaaaacgacagcggcgaatatgagcccgaggcagtgagcaaaaacatcgtcgtctgcaccggttcagtcacagacaggctcaagcgagactggggcatgaacgacgtttggaactcaatcgtatacccgcgattcgaacgcctcaattcgctaactgacacacagagcttcggccactgggaaaacaagtcggggaagaaagtattccaaacagagctgccactcgaataccaaaaagggttttcaaagaaacgaatcgaccaccgccaccacgcaatggacgcgatagtaatcgcatgcgccacacgcaaccacgtaaactacctgtcgaacgaatcagccagccgaaacgcaaaaataagccggtacgacctccagcgccttctatgcgacaaaaacaggactgacgacaacggtaactacaaatgggtcataaagaaaccatgggacacatttacccaagacgcacgggaagtcctatcgaaaatagtagtcagcctcaaacagaacctgcgcataataaacaaaacaaccaacgtatatcgacatcttgacgccaccggaaaccgcgtgtacgaaaaacagaaaaccggagactcctgggccatacggaaaccaatgcataaagacactgtcttcggagcagttaacttacgcaaagtaaaggtagtaagactgagcgtcgccctcgacaccccggcaatgatagtcgacaagagagtcaaaaacaaagtgttcgagctgctgagctacaaatacgacaaaaagcgcatcgagaaatatttcaaagaaaacgcatttctatggaaagaactagaccttgccaaggtggcggtctactattttacagaggccacgacggaaccgctagtcgcagtccgcaaaccactcgattcgaccttcaacgaaaagaagatcaaagaatccgtcacagacacaggcatccagaagatactactcaatcatctatgcaccaaggaaggcaagccagacctagcattttccgccgaaggcatcgaagagatgaaccgaaatctcctacagctcaacaacggaaaatcacaccaaccgatctacaaagtccgggtgtacgagccccgcgggaacaagttcagcgtcggggtgttgggtaacaaaggaacgaaatgggtcgaggccgcgaagggaacgaacctcttcttcgctatatacatcaccgaagacggtaaacgaacatatgagacaatacccctcaacgtggtaatcgagcgcgaaaaacagggcctcgtccccgtcccggacaggaacaagaaaggagacaagctcctcttctggttaagccccaacgatctggtatacttgcccaccgaggaagagagggagttcggacggatcaatgaacccattgaccggggccgcatatacaaaatggtctcatgcacaggcaatgaaggccacttcataccggccaacgtcgccaatccaatcgtgccagtaatagaactaggaagcaataacaaggcccaacgcgcttggaccaacgaaatgataaaggacatctgcatccctatcaaagtcgaccgcctcggccacatcatcgaagtcaaatacaggatcgatgaatga

SEQ ID NO: 6906 - RNA, 4530 nt, synthetic construct
  misc_feature 1..4530: note = Cas9 variant
  source 1..4530: mol_type = other RNA
atgaagaaaatcctaggcctggacttaggaaccaacagcgtcggatgggcagtcattaacagcgtagtcaacgatgaaggaaaggaacagctagtcaacataagctcgtgcggaagccgcatcataccaatggacgccgcgaccctcggcgacttcgacaaaggcaacagcaagagcccggtggctgagagaacaaggttgcgcggcgtgcgccgactcttagaacgaagcctcctcaggagagagcgactgcacagagtcctgtccgtgatgggattcctcccagaacactacgcagctcagctagaccgatacggaaaattcctgcctgaaacagagccgaaactagcgtggtataaggacgaaaccggaaaatacagattcctatttcaggacagcttcaacgaaatgcttgaagactttcacgaacaccaccccgagctagttgccgaaggaaagaaaatccactacgattggacaatctattacctaagaaagaaagcactttctcagaaaatcacgaaagaggaactcgcttggatactcctaaacttcaaccaaaaacgaggatactatcaactccgaggagaggaggagcaagaggacaacaagaaatcagtcgaatactacgcactcaaagtggtcgcggtagaagactccggagatcgaaaaggtaaagacatctggtacaacgtaaaactagaaaacggctgggtgtaccgccgcgccagcggcgttccactagactgggtcgggaaagtcaaagagttcatagtcaccactgacctagacgaaaagggcaatccaaagaaagacaaagacggaaacgtcaaacgctccttcagagccccgaaagaagacgactgggggctactcaagaccagaactcaagcccaaatcgacgaatcgggccaaacagtcggaacttacatctacgagagcctactcagaatgcccgaccagaaaatccgagggaaactggtcaggaccatagagcggaaatactacaaagacgagctccggaagatcctcatcaaacaaagcgaatttcacacggcactccaagaccacaacttgctcttggcctgcatcgaagaactgtaccccaacaacgaagcccaccggcgcttgctcagcaccagcgacttcacctatttcctagtggaggacattctgttctaccaacggcccctaaaatcccaaaaaggacaaatcgacgactgcccctacgaatcccacgtctaccgcgataagaaggacggctccttgcagcatgtcccactaaaatgcgtatccaagagccatcccctcttccaggagttccggctgtggcatttcctgtcattcctccggatctatcagagagaacgcatgatcgacggcagcctgaaactagacgtagacgtcaccaatgagttccttcaaaacgaagacgactacgtaaaactattcgactggcttaacgaaagaaaggaaatcgaccagaaaaccatcctggcgtacaaacccttcggattaaagaaaaacgaacaatcgaagtacaggtggaactacgtggaggacaaatcatacccatgcaattccaccagagccgatatgatattccggctatccaaagccggggtcccggaggagttcctgacacgcgaaaaggaggaggctctatggcacatactatacagcatatctgataagaaagaactcaccaaagccctaggcacttttgccgagaaaaacgggctgaacgagacgttcgtagagatcttctcaaaaatgccaccgttcgaatccgactacgcagcttattccctgaaagcaatccgcaaactactagcactaatgcgaatgggtaaatactgggacgaacaagcaatcgacgaacacacgcgaagccgcatagaaaagatcctcacgggcgagtacgacgaaaccatacgaacacgagtaagagaaaaagccatgcacctgaccgacatcagcagcttccgaggactaccactatggctcgcatgctacgtcgtctacgaccgacactccgaagccaaagagctagtcaagtgggagacccccgacgacatagaccacttcctgcgaaaattcaaacaacactccctacgaaacccaatcgtggaacaaatcataatggaaacgctccgcaccgtccgcgacatctggaaacaggaaggcaaaatagacgaaattcacgttgaactgggccgcgaaatgaagaatccggcaaaagaacgagcaagaataacagctcaagttcttgaaaacgaaaacaccaatctcagaataaaggcgctccttgcggagttcatgaatcccgagttcgaaatcgaaaacgtgcgcccatactctccagcgcaacaagaaatattacgcatatatgaagaaggagtcctgagcggggtggccgagaaggacctccccgacgacatcgcttcgatactgaagaaattcagagagaacgacgtaaagaaacggccaaccacaagcgaagttctaagatataaactgtggctagaacaacgatacaggagcccatacacaggccgcataatacccctcggtaaactcttcacccccgcgtacgaaatcgaacatgtgatcccacaaagccgatacttcgatgacagcttcacaaacaaagtgatatgcgagtccgccgtcaacaaactcaaagacaactgcctcggatatgagttcgtaaagaaacatagcggcgaaaaagtagaactcggaaacggagaaacagccactatcttctccgtagaagaatacgagcgcttcgtaaaagacagctatttcaacaacagcaagaaaatcaagaaactactactggaggacataccggataacttcatcgaacgtcaattaaacgacagcagatatatcagcaaagtcgtcaaaagcctactgtcaaacatagtctgcgaagagggggaacaagagggcatgagcaaaaacgtcatcgtatgcactggcggtgtaacggaccggctcaagaaagactggggcgtccaggacgtctggaaccggataatcctcccccgtttcctgcgcctcaataaaatgacagaccgtaccgacttcacagccgtgagcacaaacggacatctactaccagcggtgcctcttcatctgcagaaaggcttcaataagaaaagaatcgaccaccgccaccacgccatggacgcaatcgtcatagcctgcgcaggacgcaacatcgtcaactacctcaacaacgccagcgccagaaaaggatccgagatcagccgctacgatctacaacacctattatgcgataaagtcaagacagacgcgaacggcaactacaaatggattctccgaaaaccatgggagaccttcacccaggacctctacgcggcgcttaccaacatagtcgtatcattcaaacaaaacctgcgagtgataaaccgcactacaaatcactaccaacactataatgaagacggagagaagaagatgattccccagacgaagggagatcgcctggccatcaggaaaccaatgcataaagacaccgtctacggcgaagtaaacctgcgcaaggagaaaaccctgcccctcaaggacgtggttaaaaacccctccgcggtagtagacaagtcactcaagaataaactgtatgaattactcaaaagccagtacgacttaaaagcgataacaaagtacttcgaaacacaccaggacgtgtgggcagacgtgaacctcaagaaaataaaggtatactacttcaccaaagaaactaatgaacgctttttcgccacacggaaatcactcgatagtagcttcagccagaaaaagattgaagaagaggtaaccgacacaggaatacagaaaatactacttaggcacctacaacaaaatggcaacaaccctgacatagcgttctcgcccgacggagtggaacgaatgaaccaaaatatgacaatactgaacgatggaaaatggcatcaacccatatataaggtgcgcacctacgaaaaagccgacaagttcgcggtcggcgaaaaaggcaacaaagtgaagaagtttgttgaggccgcgaaggggacaaacttatttttcgcggtatatgaatctatccaagaagacgaagcaaccggaaagcaagtccgcaagcgcaccttcgcaacgatccccctcaatgaagttatcaaacgcaaaaagcagggactgcccgcagcacctgaggactccaaaggcaacctgccgatcttcgtcctgagccccaacgacctcgtgtatctgccgacagaagaagaacgcaactctggaaaaatcatccaaccactcgacagagaacggatctacaagatggtatcctgcacagaaggagagtgccattgcatccccgaatacgtggcaaacccaatacttcaaaccatcgagctagggagcaacaacaaagcccagcgcgcctggtctggcgaaatgataaaggagatctgcgtccccgtcaaagtcgaccgcttgggcaacgtcagccttataaaaatctga

SEQ ID NO: 6907 - RNA, 4530 nt, synthetic construct
  misc_feature 1..4530: note = Cas9 variant
  source 1..4530: mol_type = other RNA
atgaaaaccatattaggactggacctgggtacaaatagcgtaggctgggccgtgataaactccgtcatcaaggaacaagccgaaagaatctggatagaaaccgccggctcccgaatcatccccatggacgctgccgtgcttggcgatttcgacaagggcaacagcatctcacagacttcagagcgcacccgcctgcgaggagcacggcgactccgcgaacgccagctactgagaagagaaagactccataaagtgctcaacattctcggattccttcccaatcactacctggagtacatcgacttcgaaaaacaccccggcaaattcctggcggatgcggagccgaaactcgcttgggtaaaagacgagcaaggcaaatacacctttcttttccaggcagccttcgatgagatgcttgccgacttcgccatccatcaaccctcactcgtcagtggcgacaagaaaataccctatgactggacaatctactatctgaggaagaaagccttgacagaaatgatcagcaaagaggagctagcatggatcctactcaatttcaaccaaaaacggggatactaccaactacgcggtgaagaggaagaagacaacgccggcaaaagcgttgaattttacgcactgaaggtacttacggtcgaagccacagacgagaagaagggcagagacgtatggtacaacgttcatctcgaaaacggatggatataccgaagaagcagctccgtgcccctagactgggaaggacaggttaaagagttcatcgtcactacagacctcaaccccgacggcacaccaaaactagacaaatacggggaagtcaagcgatcgttccgcgccccaaaagaggacgactggatgcttatcaaaaagcgcacagaagctgacatcgcaaacacccataaaacggtgggcgcctacatctacgacacactactacaaaagccacaacagaaaataataggtaaactcgtcaaaacggtcgagaggaagctataccgagacgaactcagcctaatcctccaaaaacaatgcgccttccatgctgaactacaagaccgcgctctatatgcgcgatgcgtcgaagccctatacccaagcaatgaagtgcgaagaaagaacatcgcaaaccgagacttcgtctacctcctgatggacgacattctgttctaccaaaggccactaaaaacaaagaaatcgctcatagccaactgcccctacgaggaaaacgaatacgttgacagagagacaggtgaaataaagaaagcacccctgaaatgcatcgcaaaatcacaccccctattccaagagtttcgcctatggaacttcctctcaaacatcagaatctatcagaaagaaaaggaaatcaacgggactcttcacctcgatgtagacgtaacagccgagttccttaaaaccgaagacgactatgttgccctattcgactggctgaatagccgaaaggaaatcgaacaaaagacctttctcaagtaccctaaattcggcctcaagaaagagatcagcaactaccggtggaactacgtcgaggataaacaatacccttgtaacgagacgagacatgcgatactcagctcattggaaaaggcaaatgtatgtatcgacttcctaagtaacgagaaagaggtcgctctctggcacattctatacagcgtatctgacaagcaagagatcgagaaagccctgcgaaccttcgccgccaaaaacggtctagacgagagcttcgttgaggccttcaagaaatttcccccattcaaaagtgaatacggagcttactcggccaaagccatcaagaaaatgctgccactgatgagatgcgggaaatactgggatgtgtccagcatcgacgacacaaccaaagaacgaataaagaaaatcgtcacaggcgaatacgacgaaagaatagcggtcaaagtccgagacaaagtcatgaaccttagcgacatcagctgcttccgacgacttccgctctggctcgcctgctatatcgtatacaacaggcactccgaggacaaagaagccgtcaaatgggagtcaccggccgacatcgacgcctacttagcctccttcaaacagcactcgttaaggaaccctattgtagaacaggtaataacagaaacgttgcgcgtcgtcagagatatatggaaacaagttgggcggatcgacgagatacacatagaactcggtagagagatgaaaaaccccgccgacaaacgcaaacgcatgaccgcgcaaatcctagaaaacgagaacgccaacctgcgcattaaagccctgctggctgaatttatgaaccccgagtacgagattgaaaacgtcaggccgtactccccaagtcagcaagaaatactcaggatatacgaggacacagtactccatgcggaagaccaactacccgaagaaattgacgcgattctaaagaaattcaactcgtcgaaagtcccgacaaaatcagaatttctacggtataaactatggcttgaacaaaaatatagaagcccatacacaggagaactgataccgctaggaaaactcttcaccgcagcctacgagatagaacatgtcataccccagagcagatacttcgatgatagcttctccaacaaagtgatatgcgaatcggcggtcaacaaactgaaggacaaccagctgggatacgagttcatcaagaaccatcacggacaaaaagtcgaagtaggattcggcaaatcagtagaaatcttttccgtcgacagttacgaaagattcgtcaaggaacaatacgcaaaatccgcagtcaaaatgaagaaactactcatggacgacatcccagaacagtttatcgaacgacaacttaacgacagtcgctacatcagcaaagtcattaaaggactactctcgaacatcgtcagagagaaaaacgacagcggagaatacgaacccgaagcggtgtccaaaaacatagtcgtttgcacaggaagcgtcacagacagactgaaaagagactggggcatgaacgacgtctggaacagtatagtatacccccgcttcgaaaggctgaactcactgactgacacgcaaagttttggccactgggaaaacaagagcggcaagaaagtattccaaacagaattaccgctcgaataccaaaaaggcttcagtaagaaacgcatagaccaccggcatcacgccatggacgccatcgtaatcgcatgcgcgacccggaaccacgtaaactatctaagtaacgaatcagcctcccggaacgccaaaatctccaggtacgaccttcaaaggctcctctgcgacaagaaccgaaccgacgacaacgggaactacaaatgggtaataaagaaaccctgggacacattcacccaagacgcccgcgaagtactctccaaaatagtggtcagcctaaaacagaatctacgcatcataaacaaaacaaccaatgtctaccggcacttcgacgcaaccgtaaaccgcgtatacgaaaaacaaaagacgggagactcatgggccattcggaaaccaatgcacaaagacaccgtgtttggcgcggtgaatctccgtaaagtcaaagtagttcgcctaagcgtggcgctcgacacgccggccatgatagtcgacaaacgcgtcaaaaacaaagtctttgaactcctcagttacaaatacgacaaaaagcggatagaaaaatatttcaaagaaaacgcattcctgtggaaagaactcgacctcgccaaagtcgccgtctactatttcaccgaggcgacaaccgagcccctcgtcgctgtaagaaagccactggactcgacattcaacgaaaagaagatcaaggaaagtgtaaccgacactggcatacaaaagatattactgaaccacctatgcacgaaagagggtaaaccggacttagccttctcggcagaaggcatagaagagatgaaccgcaacctacttcaacttaacaacggcaagagccaccagcccatatacaaagtacgagtctacgaaccacgcggcaacaagtttagcgtaggggtactaggcaacaaaggcacgaaatgggtggaggccgcaaagggcacgaacctattcttcgcaatctacataacggaagacggaaaacgcacatatgaaaccatacccctcaacgttgtcatcgaacgagagaagcagggacttgtccccgtcccggacaggaacgaaaaaggcgacaagttactgttctggctgagcccgaacgacctagtgtacctccccaccgaggaagaaagagagttcggacgcataaacgaacccatcgaccgaggacgtatatacaaaatggtctcctgcacaggcaacgaggggcacttcattcccgctaacgtggcaaatccgatagtccccgtgatcgaactcggttcaaacaacaaagcccagcgagcttggaccaacgagatgatcaaggatatatgcatccccatcaaggtcgaccgcctaggacacataatagaagtgaaataccgaatcgacgagtga

SEQ ID NO: 6908 - RNA, 4530 nt, synthetic construct
  misc_feature 1..4530: note = Cas9 variant
  source 1..4530: mol_type = other RNA
atgaagaaaacccttggactcgatctaggcacaaactccataggatgggccgtaataaactcaaatatcgactccgaaggcaaagaaaaactggtaggcataagcagctgcggctcgagaatcatccccatggacgccacgaccctgggcgattttggcaagggcaacaccaaaagcccggtagcagaaagaacacgtctcagagggatacggcgcctactcgaacgaagcctgctacgacgcgagcgcctgcaccgcgtactatcggtgatgggtttccttccagagcactacgccagccaactagacagatacggcaagttcctacccgagactgagccaaaactcgcatggtacaaggacgacagcggccggtaccaattcctattccaaaaatctttccacgagatgctagaggatttcagacaacaccagcccgaattagtcgccggcgagaaaaagattccctacgactggaccatctactacctacggaagaaagccctttcgcaagagataaccaaggaggaactcgcctggatccttctaaacttcaaccagaaaagaggatactaccagctacgcggggaagaagaacaggaagaaaacaacaaatcggtggaataccacgccctaaaagtcgtatccgtcgaagactctggagagcggaagggcaaagacatctggtacaatgtaacactcgaaaacgggtgggtctaccggagggcatcgaatatccccctggactggactggaaaagtcaaggagttcgtggttacgacggaactagacgacgccggcaaccccaagaaagacaaagaagggaatgtgaagcgcagcttccgagctccgaaggaagacgactggggtcttctgaaaacacgcacccaagcacagatagacgaatcaggcaagactgtaggaacgtacatatacgaatcactgctatgcatgcccaaccagaaaatccgagggaaactcgtgcgtaccatcgaaagaaaatactacaaggacgaactccggcaaatcctcgtcaaacaaagcgagttccacgcagcactgcaagatcataacctcctactatcgtgcatcgaagaactatatcccaacaatgaggctcaccggaggctactcagcgcaagctcattcatatacttcctcatcgaagacattctattttaccaaaggccactaaagagccaaaaggggctcatcgataattgcccctatgaaagtcacatctataaagacaagaaagacggatcactacaccatgtcccccttaagtgtgtcagcaaatcccatccccttttccaagagtttaggctctggcaattcctgtccaacctgcgaatctaccaaagagaacgcatgatggacggatccctaaaattagatgtagacgtcacccgcgagttcttacccagcgaagaagactacgtgaaactcttcgactggctgaatgaaaggaaagagatcagccagaaattcctactagcatacaaacccttcgggctcaagaaaaacgaacaggctaattaccgatggaactacgttgaagataagtcctacccatgcaacgaaacacgagcggaaatcaaatcccgattgtcgaaagcaggagtcccagaggagttcctaacggaagaaaaagaagaggccctctggcacatcctgtactcaataagcgacaagaaagaactgaccaaagcactcgggacattcgcagcgaaaaattgtctcaacgaatcattcgtagaggtattcgccaaaatccctccgttcgaaagcaactacgccgcctacagcctaaaagcgatccgcaaactactagccctaatgcggatgggaaagtactggaacgagcaagccatcgatcgccaaacccgcgataggatagagaaaatactcaccggcgaatacgacgaaacaataagatccagggtccgcgaaaaagccatgctcctgaccgacatcagctcattcaggggcctcccattatggctcgcgtgctacatagtctacgacagacattcagaatctaaggaactcgtaaaatgggaaactccggcagacatcgaccacttcctatccaaattcaagcaaaactcccttcgcaacccaatagttgaacaagtcatcaccgagtcacttagaacggtacgcgacatatggaaacaggaagggaagatagacgagatacatgtagaactcgggagggaaatgaaaaaccccgcgaaagaacgagcgcgcatcaccgcgcaagtgcaggaaaacgagaacaccaacctcagaatcaaagccctcctagctgagttcatgaacccagagttcgaaatcgagaacgtacacccctattcgccggggcagcaggaaatcctccgcatctacgaggacggcgtcctgtcaggcattgccgaaaaagacctcccagacgacataaccgcaatcctcaagaaattccgagaaaacgacgtgaagaaacggccgaccaccagcgaagtactccgctacaaactatggctcgaacagcgctaccggagcccatataccggacgcgtcatccccctcggcaaattattcaccccagcctacgaaatagagcacgttatccctcagagccgatactttgatgacagcatcagcaataaagtcatctgcgaatccgctgtcaacaagctcaaagacaactgccttggatacgagttcatcaaaaagcacagcggggaaatggtagaacttggaaacggagagaccgtacccgtatttagcgtcgaagaatatgagcgatttgtaaaagaatcctatttcgggaactcgaaaaagatgaagaaacttctcctagaagacataccagactccttcatagagcgccaactcaatgacagtcggtacatctcccgcgtagtcacgagtctcctcagcaacctcgtctgcgaggaaggggaacaagacggtttaagcaaaaacgtaatcgtctgcacgggcgggatcaccgacagactaaagaaagattggggcgtccaggaggtctggaacagaatcatcttaccccgattcctacgcctgaacgaaataaccgggcgaaccgatttcacgtcaaccagtgtgaacggtcatctgcttcctgcactacccctatacctccagaaaggctttaacaagaaacgaatagaccaccgccaccacgcaatggacgccatagttatcgcctgcgcgaacaggaacattgtcaactacctcaacaactcgtcagcacgtaaaaattcagaaatcagcagatacgatctgcagcgtttgctctgtgagaaagtcaaaacagacgccaacgggaattacaagtggatactgcgcaaaccttgggaaacattcacacaagatgtgtacgccgcactcacgaacatcgtagtgtccttcaaacaaaacctcagggtcattaacagaaccacaaattattaccaacactacaacgaagccggagagaaacgaatgatcccccagacgaagggcgacagatgggcgatcagaaagccgatgcacaaagacacggtttacggggaagtcaatctccggaaggagaagaccctgcccctccgcgacgtggtcaagaatccgtccatagtggttgacaaatccctcaaaaacaagctatacgaactcctcaagagccaatacgacttgaaagccatcgcgaaatatttcgagacgcaccaggacgtatgggcagatgtgaacctgaagaagataaaggtctactattttactaaagagaccaatgagcgattcttcgccacgcggaaatcactagacccctcattcgatcagaaaaagatcgaggaagaagtaacagacacaggagtccagaagatactattgcaccacctccaacagaataacaacgacccggatatggccttctccccagacggcatcgaccgcatgaaccaaaacatgaccatactgaacgacggcaagtggcaccaacccatatacaaggtacgtacctacgaaaaagcagataaattcgccgtaggcgagagcggcaataaagccaagaaattcgtcgaggccgctaaaggaacaaacctattcttcgcggtctacgaatccgttcaggaggatgaagccatcggaaaacaagtctgcaaacgaacgttcgccaccatcccactcaacgaggtcatcaaacgcaagaaacaaggcctaccggcagcacccgaagatctcaacggtaatctaccaaaattcgtactaagcccgaacgatctagtctacctacccacagaagaggagcgaaactcaagcagaatcatacagcccctagaccgcgaaaggatatacaaaatggtcagctccagcggcagccagtgcttcttcataaaagtgttcgtagcaaattcaatctgggacaaaaacgaatacagttcactaaacaaaatggagcgcgcaattaccaacgaaatgatcaaagaaatctgcgttccaataaaaatagatcgcctggggaacgttagcttgatccaaatctga

SEQ ID NO: 6909 - RNA, 4533 nt, synthetic construct
  misc_feature 1..4533: note = Cas9 variant
  source 1..4533: mol_type = other RNA
atgaaaagaatcctaggactggaccttggaacaaactcaataggatgggccttagtagacagcgaagaacaaagaatactaggcatgggctccagaattatacccatggaccaaggggtcctcgacacgttcagcggcggaaacccggtagagacccaaacagcagcccgaacagtgtaccgcgggacacggaggctccgagaacgggccctactgcgacgcgagcgactgatcagagtccttaacatgatgaaattcctacctgaacattacgcgtcacaaatcgacttcgaaaaacggttaggccaattcttcgacgagaaagagccaaaactcgcatggaaacaaaacgacgaaggccgattcgagttcatcttccaacagagcttcaacgaaatgatcgaagagttcaagaacaagggtgtagtacgtgaagacaaaaagatcccctacgactggacgatctactacctccggaagaaagccctaagccaagagatagaaaaagaggaactagcctggatcctcctcaattttaatcaaaaacgaggttactatcagctacgcggcgaggaggaggaagagaaccccaacaagctcgtcgaatactattccctcaaaatcgtagacgttatagctgacgaaaaaccgaactctaaatcagacatctggtattccctacacctcgaaaacggttggatataccgacggagcagcaaaatccccctcttcggatggaaagataagacccgcgactttatcgtgaccaccgacctgaacgacgacgggacagtgaagaaagataaagagggcatagaaaaacgcagcttccgagccccctcagaaaacgactgggtcctgttgaaaaagaaaactgagagcgacatagagaaatcccacaaaacggtcggcgcttacgtttacgaaacactactccaaaaccccatgcaaaaagtccggggaaaacttgtccgaacgatagaacgaaaattctacaaggacgaactcaagcaaatcctagaaaaacagcgcgagttccaccccgaacttcgtgacgaggacctgtacaatgattgcgtgagagagctctacaggagcaacgaaacctaccagttcatcctgagcaaaagagacttcgtccacctgttccttgacgacatcttattctaccaacgcccgctccgatcccaaaaatcagctataggcgactgcatcctcgagttcaaaacgtataaagacaaggatggcaacaacatcaaggaataccttaaagtaatatcaaagtcaaacccattgtatcaggagttccgaatctggcaatggctctataacttgaaaatctaccgtaaggaagacgacgaagacgtaacactccagtttatcgccaacatcgaggacaaagaacagcttttcgatttcctaagcaaccgcaagtccatcgagcaaaagccactactcgaatacctaataaaagccaaagggctcaagaaacaggtcaaaacagaggcttacagatggaactacgtcgaagacaaaatctacccctgctccgagaccaaaacgatgatcagcacgcgactagccaaagtagaaaacatccccgacaacttcttcaccaaagaaatagaacaaaagctctggcacatcatctacagcgtaacggataagaacgagttcgaaaaggcgctgcgcaccttcgcaaagaaatacgacctcgacatcgcttccttcgtagacaacttcaagaaaatcccaccgttcaaaaacgaatacggctcttttagcgagaaagcgataaagaagctactccctcttatgcgcctgggaaaatactggaaatggaacgacatagacaacaacacccagaaccgcatatcgaaaatcattaccggcgaatacgacgaagaaatcaaggacatcgtccgagaaaagagcatcgcgctcacaaacgagaacgacttccaagggctgcaactgtggctagcccaatacctagtctacggccgccactccgaagctgatatagcggggaaatggcacagcgtggctgacctcgagaagtatctaaacgagttcaagcagcactcccttcgcaatccgatcgtggagcaaataatcacagaaaccctaagagtagtccgcgacatttggcgtaagtatggacagggagcggaaaacttcttcagcgaaatccacgtagaactcggacgggatatgaaaaacaccgccgacgaacgcaagaaaatagtaaacgtcgtcactgagaacgaaaacacaaacctacggattaaagccctcctcatggaactcaaaaacaatagcgacggaaaactagaggtagaaaatgtgcgcccctacagccccacccagcaagatatattgaaaatttacgaggagtacgcgatatccacagggctagacaacgagaaagacgaaaaagtcaaagaagacatcaaaaagataagccgcgtcgcccaacccactaccacagagctacagcgttacaaactctggctcgagcagaaatactgctctccgtataccgggaaggttatacccctaggcaaactattcaccgaggaataccagatagaacacataatacctaagagccgctactacgacgactccttctcgaacaaagtcatatgcgaggcggccgtcaacaaacttaaagacaagtgcctaggcctagagttcatcaaaaactaccacgggcaaatagtcgaaaccggcttcggacagaaagtaaccattttcgacgaagaagcctaccaaaacttcgtaaagcaacactacgcctacaaccacagcaagcgtacgaagttgctactagaagagataccggaaaagatgatcgaaaggcagatgaacgacacgagatacatctcgaaattcgtgctaccactcctgagcaacctagtaagggcaaaggaaaacgacaacggggtaaactcgaaaaacgtcctcccagtgaacggcaagatcacaactatgctcaagcaagactggggactaaacgacgtgtggaatgatctaatactcccacgattcgtgcggatgaacgaactggctaaaacgatcgcgttcacatcctggaacgaacaacaccaaaagtacctccccactgtccccttggagctcagcaaaggattccagaagaaacgaatagaccaccggcaccacgccatggatgctctcgtaatagcatgcgctacccgagaccatgtcaatctcctcaacaacaagcatgccaacaccgacacgatacggtacgacctgcaaaggaaactcaggcttttcgagagggtaacgtacatcgacccgcaaaccaaaaacaacgtcacaaaagacataccgaaagagttcaaaaagccttgggacaatttcaccgtagacgcgagaaacgaactagagaaaattatagtcagcttcaagcaaaatctacgcatcatcaataaggctaccaacatctacaccaagtacgaaaatggcaaaaagatcaaagtcggccaaaagggactcaactgggcaattcgcaagccgctacacaaagaaaccgtattcgccaaagtaagtctacgcaaaagaaaaaccgtgcgcttatcagaagcactcaaggactggaaaaagatcgtggacaagaaacttaaacaagaaataaagcggcttacctgccaatacggcaagttcgacgtagacaccatactacgttacttcaaagaccgcaaataccagttcggagaagtagacgtatcgaaggtcaaaatgtactacttcgacgaagaaaacgcagccgtaaggaagaacgtggatacctcattcacagagaaattcatccaagggtccgtcacggacaccggtatccagaaaatcctcctaaatcacctcgaagccaaagggaacaaggtagaaatagcattctcccctgaaggaatcgaggagatgaacaaaaacattatccaactcaacgaagggaagctccacctcccgatctttaaagttagggtatacgagacgatcggcaacaaattctcagtgggtgtaaagggcaacaagaaagataaatacgtggaagcggccaaagggactaacctctttttcgcgatatacgtggacgagaacggcataagatcatatgaaacaatccccctaaacatcgtaatcgaacgactaaagcaagggctaagcgtcgttccggaaaagaaccgcaaagaacacagcctactattctacctgagtcctaacgacctggtatacgtaccaatagaggacgaacgcgagaatatacacgccgtgaacctagaccaactcaacaacgaacaaagaaaacgcatctataaaatggtatcctgcacagggtcggaatgccacttcgtaccctattatgtagccagccccattgtgaataaggtggaatacagctcgctaaataaaatcgggcgtagcctcactggcgagatgatcaaggacgtatgcatcaaactaaaggtcgatcgcctgggcaatatcaagggtatctccggtctctga

SEQ ID NO: 6910 - RNA, 4533 nt, synthetic construct
  misc_feature 1..4533: note = Cas9 variant
  source 1..4533: mol_type = other RNA
atgaagagaatactcggacttgacctaggcaccaatagtatcggctgggctctggtcgactctgaagaacaaaggatcctcggcatgggatcgcgcatcatccccatggaccagggggtactcgacacattctccggcgggaaccccgtagagacccagaccgccgcacgcaccgcctaccggggcacgcgaagactacgagaaagagccctccttagacgagagcgtctaatcagggtcctaaacatgatgaaattccttccggaacactacgccagtcaaatcgacttcgagaagcggctgggccagttcttcgatgaaaaagaaccgaagctagcctggaaacagaacgacgagggcagattcgagttcatcttccagcaaagttttaacgaaatgatagaagagttcaaaaataagggagtcgttcgagaggacaagaagattccctacgactggaccatctactacttgagaaagaaagccctatcccaggagatagagaaggaagaactggcgtggatcctcctaaacttcaaccagaaacggggctattatcagctccgcggcgaggaagaagaggaaaatcccaacaaactcgtcgaatattatagcctgaaaatagtggacgtgatagcggacgaaaagcccaactcgaaaggcgacatctggtacagcctccacttagagaacgggtggatataccgacgaagcagcaaaataccactcttcggatggaaagacaaaacgcgcgactttatcgtgacaactgatctcaacgacgacggaaccgtcaagaaagacaaagaaggaattgagaaaaggtcattccgagccccgtccgaaaacgactgggtcctgttaaagaagaaaacggaatccgacattgaaaagagccacaagacagtcggggcatacgtgtatgaaaccctgctacaaaaccccatgcaaaaagttcgcggaaagctagtgcgcaccatcgagcgcaaattctataaagacgaactaaaacaaatcctagaaaaacagagggagttccatccggaactacgcgacgaagacctctacaacgactgtgtaagagagctgtaccgatccaacgaaacctaccaattcatcctctcgaaacgcgacttcgtacacctcttcctcgacgatatactattctaccaacgcccgctacggagccaaaaatcagccattggcgactgcatactcgagttcaagacatacaaagacaaagacggaaacaacatcaaggagtacctgaaagtgatcagtaaaagcaaccccctctaccaagagttcaggatatggcagtggctgtacaatctcaagatataccggaaggaagacgacgaggacgtcacactccaattcatcgccaacatcgaggacaaggaacaactcttcgacttcctatcgaacagaaaatcgatcgaacaaaaaccgttactcgaatacctaataaaggccaaaggtctcaaaaagcaagtcaaaaccgaagcctaccgatggaactacgtcgaagacaagatctacccatgctcagaaactaaaacaatgatctcaacacgcctcgccaaggtcgagaacataccagacaacttcttcactaaggagatagagcagaaactctggcacataatatacagcgtcacagacaagaacgagttcgaaaaagccctgcgcacgttcgcgaagaaatacgatctcgatatagcgtccttcgtagataacttcaaaaagatcccacccttcaagaacgagtacggctcgttctccgaaaaagcaatcaagaaactgctcccgctaatgcggcttggcaaatactggaagtggaacgatatcgataacaacacccaaaaccgcatatccaaaataatcactggggaatacgacgaagaaattaaagacatcgttcgcgagaagtcgatcgctctaacaaacgagaacgacttccaagggctacaactgtggctcgcgcagtacctcgtctacggcagacattccgaggctgacatcgccggaaaatggcactcggtagccgacctagaaaaatatctgaacgagttcaaacaacacagccttagaaaccctatagtagaacagataatcacagaaacgcttcgcgtagtgcgcgacatctggcgcaagtacgggcagggcgccgagaacttcttcagtgagatccatgttgagctcggccgggacatgaaaaacaccgccgacgagagaaagaaaatagtcaacgtagtaaccgaaaacgaaaatacgaacctaaggatcaaggcgctcctcatggagctcaagaataactctgacggcaagctcgaggtggagaacgtgcgcccttacagccccactcaacaagatatcctgaaaatatacgaagagtacgcaatctctaccgggctcgacaacgaaaaggacgaaaaggtcaaggaagacatcaaaaagattagcagagtcgcgcaaccgaccacgactgagcttcaacgctataagctctggctagagcaaaagtactgcagcccctacacaggcaaagtcatcccccttggaaaattattcacggaagagtaccagatcgagcacatcataccaaaatcgagatactacgacgactccttctctaacaaggtaatatgcgaggccgccgtcaacaaactgaaagacaaatgcttagggctagagttcatcaaaaattaccacggacagatagtagaaaccgggttcggccaaaaagtcacaatatttgatgaagaagcgtaccagaacttcgtaaaacaacactacgcctacaaccgcagcaagcgcaccaagctgctcctggaagagatacccgaaaagatgatagagcggcaaatgaacgacacgcggtacattagtaagttcgtcctaccccttctaagcaacctagtacgagccgaggagaacgacaatggggtaaacagcaagaacgtcctaccagtcaacggaaagataaccacgatgctgaagcaagactgggggctaaacgacgtctggaacgacctgatcctgccgcgcttcgttagaatgaacgaactagccaaaacaattgctttcaccagttggaacgagcaacaccaaaaataccttccgacggtcccacttgaactctccaagggattccagaaaaagcggatagaccacaggcaccacgcgatggacgcgctcgtcatcgcgtgtgcgacgcgcgaccacgtgaacctactcaacaacaaacacgcaaacaccgacactatccggtacgacctacagagaaaactacgcctgttcgagagggtaacatacatagacccccaaaccaaaaacaacgtcacaaaagatataccaaaagaatttaagaaaccgtgggataactttaccgtagacgccagaaacgagctcgagaaaattattgtcagcttcaaacagaacctgcggataatcaacaaagccacgaacatatacacgaagtatgaaaacggaaagaaaataaaggtggggcagaaaggattaaactgggccatacggaagcccctgcacaaggagacggtgttcgcgaaagtctccctcaggaagaggaaaaccgtccggctgagcgaggcactcaaagactggaagaaaatagtggacaagaagctcaaacaagagatcaaacggctaacctgccaatacggtaaatttgacgtagatacaatactgcggtacttcaaagacaggaaataccaattcggcgaggtcgacgtctcaaaagtgaaaatgtactacttcgacgaagaaaacgcagccgtacggaagaacgtagataccagcttcacagagaagtttatccagggtagtgtaaccgacacagggatccagaaaatacttctcaaccacctcgaggccaagggaaacaaggtcgaaatagctttctccccggaagggatcgaagagatgaacaagaacatcatacaactgaacgaaggaaagctgcacttgccaatattcaaagtacgcgtgtacgagaccataggaaacaaattctccgtcggggtaaagggaaacaagaaagacaagtacgtggaagcagcgaaagggactaacctattctttgctatctatgtcgacgagaacgggatccgctcgtacgaaacaatcccactgaacattgtcatcgagcggttaaaacaaggactaagcgtggtccccgagaaaaatcgaaaggaacactcgctgctattttacctttcaccaaacgacctcgtctatgtgcctatcgaagatgagcgagaaaacatccacgccgtaaacctagaccaactcaacaacgaacaaaggaaaagaatatacaagatggtgagctgcacaggcagtgagtgccacttcgtcccgtactacgttgcgtccccaatcgtgaataaagtggaatactcgtccctcaacaaaatcgggcgctccctgaccggcgagatgatcaaagacgtatgtatcaaattaaaggttgacagactcggcaatgtaaaaggaatatccgggctatga

SEQ ID NO: 6911 - RNA, 4536 nt, synthetic construct
  misc_feature 1..4536: note = Cas9 variant
  source 1..4536: mol_type = other RNA
atgaagaaaatactgggcttggacctaggcacaaacagcatcggctgggcagtaatcaacagcgttgctgatgaatcggtcgaaaagcgcaatattgagctcgccggcagccggatcatcccgatggacgccgcagttttaggcaacttcgacaatggggtcaccaagagccaaacggccgagcgaacctcatacaggtccatcaggagactccgcgaacgacaacttctgagacgcgagcgactacacaaagtgctgcaaatcctcggattcctgccagagcactacgttaacgacatagacttcgagaaccacccaggaaagatcaaaaagaacacagaacccaaactcccatggcgcaaaaacagcatgggacaattcgagtttatattccaagcgagcttcgaggccatgctaacagactttgccacgcaccagccggtcttcgtcagcgaggggaagaaagtgcactacgactggaccctctactacctccggaagaaagcgctcactgaggaaatatcaaaagaggaactagcgtggatcatcctcaactttaaccagaaaagagggtactaccaactaaggggagaagaggaagaagaacaatcaaataaactcgtcgagttctacgctctgagagtggtaaaagtagaggccacggacgacaagaaaggaaaggacacatggtacaacgtccacctcgagaacggatggatctacagacgcacgtcgaacatccctctcgattgggaaggcaaagtcaaggagttcatcgtaactacagaccttaacgaagacggaacacccaagctagacaaatacggagaagtcaagcggagcttccgagccccgaaggaggacgactggactctaatcaaaaagaaaacagaaagcgacatagccaactcacataaaaccctagggtgctacatctacgacgcgctgctacaaaacccgaaccagaaaataaaaggcaggttggtccgcacagtcgagcggaagttctacaaggaagaactacgcctgatcctagaaaaacaactaagtttccacccagaactacaagaccgcgatttataccgcgcctgcatcgacgccctatacgtgagcaacgaggcgcataaaaacaatatcagcggacgggatttcgtttatctcttcatagatgacatcatcttctaccagcgcccactcaaaacaaagaaaagcctaatcgataattgtccatacgagaagaaccaatacatggaccgcgagacaggagaagtaaaacaggcacccatcaaatgtatagcaaaatcgcaccccctcttccaggagttccgcctctggcaattcatctccaatattaggatataccagcgggaacgtgtcatggacgacggaaaattggaaacagacgtagatgttacgcccgacttcttaaagacagaagacgattatacaaccctcttcgaatggctcaacgatcgcaaagaagtcgaccagaaagcatttctcaaaaatccccaatttggactaaagaaaaccttcacagaatatcgctggaattacgtggaagacaaaagctacccctgtaacgaaacgagaaacgcgatcctgaacggactgcaaaaagcaggggtcagcgcggatttcctcagcagagaggtcgaggaggcactctggcacatattatactctgtggaagacaaaatagagatcgagtcggccctccgcaaattcgcaagcaagcacgacctcgacgaccgcttcgccgacgtcttcaagaaacttcccccgttcagaaaagagtacggagcctacagcgcaaaagcgatcaagaaactcttgccgctaatgcgaatggggaaatactgggagctaagcaacatagacgacaagaccaaggagagaatagacaagatcataacgggagagtgggacgaaaacatacacaaccgagtcagggaaaaagcgatcaagctaagcgacataacggatttcaaaggattgcccctgtggctctcctgctacgtcgtgtacaaccgacacagcgaagctagggcaatcgcaaaatgggaatcgccggaagacatagacagctatctcagactttttcgccaacactcgctacgcaacccggtggtcgaacaagtaataaccgagaccctacgcacagtcagagacatatggaaaaggatcggacaaatagacgaaatccacgtagagctcggccgagaaataaagaacccagccgacaagcgcgcaaagatgaccgcgcagatcgtcgagaacgagaacaccaacctacggatcaaggccctcctagcagagttcattaattcagaatacgaaatagaaaatgtacgaccctactccccaggacagcaagaaatcctacgaatctacgaggacaccgtactcaacagtgtcgaggagatcccagaggacatctccgccgtcttgaaaaagttccgggagagtgacctgaagaaacgaccaacaaaaagcgagttcctacgctacaagctatggctggaacagaaataccggagcccctacacaggggacatcatccctctggggaaattatttacaagcgcttacgaaattgaacacatcatcccgcaatctcgatatttcgacgacagcttctcgaacaaagtaatctgcgaggcagaagtcaacaagctcaagtcgaatgaactaggctacgagttcatcaaaaaccatcacggacaatacgtcgaaataggctttggcaaggtggtccaaatattcagcatagaagcatacgaaaaattcgtgaaggcaaactatagtggaataggctcaaaaatgaaacgcttactcatggatgacatcccagaaacgttcatcgaaaggcagctcaacgatagccgatacattagcaaagtcgtaaaaagcctattaagcaacatagttcgagaaaaagacagtaacggcgaatacgaacccgaggcaataagcaaaaacgtcatagtctgcaccggctcagtcacggaccggctcaaaagagactggggtgtcaacgatgtctggaactcgatcatttacccccgattcgagcgcttaaacgagctaaccggatcgcagcagttcggatgctgggagaacaaagaaggcaaacgggtgttccaaaccgcggtaccactagaaatgcagaaagggttcagtaagaaacgaatcgaccataggcaccatgcaatggacgccatagtcatagcctgtgcaatccgaaaccacatcaactacctatctaacgaatcagcaagcaagaaagcaaaaataagtaggatcgacttacaaaggctactatgcacgaaatgccgaacagacgacaatggcaactacaaatggatcgttaaaaagccctggcccgcattcacccaagatatcagaaaggcgctagaaaatattacggtgagtttcaagcaaaacctacgggtcataaacaagaccactaactactacgtacactttgacgagtcgggcaaaaaggtgctcgagaagcaaatcaacggagacagctgggcgatccgtaagccgatgcacaaggacaccgtatttggcaaggtaaacctccaaaaagtaaaagaagtacgcctttcactggcactagacacccccaagatgatcgtcgacaagaaattaaaagaaaaagtcctgcaactctactcatacaaatacgacaagaaacggatcgacaaatattttaaagaaaacgccagcctatggaaagacctcaacctctccaaagtggccgtatactacttcacaaatgacagcaccgagccactcgtggcggtccggaaaccgctcgacaccagcttcaacgccaagaaaatcaaagaatctgtaacagacaccggcatacagaaaatcctactgaaccatctctcaaacaaccaggacaatccgaacctggccttcagccccgatggtatagacgaaatgaacaggaacctgacaacgctgaacgacggcaaatatcaccagccaatatacaaagtaagggtatgtgagccccaagggaacaaattctccgtagggacaagcggtaacaaaaccagcaaatatgtggaagcggcgaaaggaacaaacctcttcttcgccgtctaccaaacagaagatggcaaaagaaactacgaaaccattccacttaatgtcgtcatagaacgagaaaaactcgagtgggccccagtacccgaaaacaacaacaacggagacaagctactgttttggctctccccgaacgatctcgtatacgtacctaccgcagacgaactcaacaatgggatgcgcctcgataacatggacaaagggcggatctacaaaatgataagttgcagcgggccccaatgctttttcataccccaaaacgtatccaaccccatcattccagtaattgaactcggcgtcaacaacaaggccgagaagtcctggaacaacgaaatgatcaaagtagtatgcgtcccaatccgcgtggaccgcctcggctgcatcacgcaaataaacaaccagaagtga

SEQ ID NO: 6912 - RNA, 4539 nt, synthetic construct
  misc_feature 1..4539: note = Cas9 variant
  source 1..4539: mol_type = other RNA
atgaagaaaatcctcggtctagacctaggaactaactcgatcgggtgggccctcatagagaactccttcaccgaaaaagaaggtaaaatcaacgacatgggcgtccgcataatccccatgagcgccgacatcctgggaaaattcgatgccggccaaagccactcacagacggcggaacgcactggctacagaggcacccgaagactctaccaacgggataaccttcgccgcgagcgactgcacagagtactacatatcctaggattcttgccaaaacattatgacgaacacatcgacttcgaaaaacgccttgggcaattcaaagaagggaaggaaataaaactaaactaccgatgcaacgtcgaaaacaagcacgagttcatcttcataagttcgttcaacgagatgctcaccgagttcaagaaggcacaacctgaactcttctacctgaaaagcaacggagaagaaaccaaaatcccgtacgactggacattatactacctccgcaagaaagctctatcgcaacccctcacgaaacaagagcttgcatggatcatcctcaatttcaaccaaaaacgtggctactaccagctgcgcggagaggagatagatgacgacaaaaacaaacaatttgttaaactaaaagtcaaggaggtcatcaactcgggcgaggctgtcaaagggaaaccactattcgatgtcatcttcgaaaacgggtggaaatacgacaagcaagtagtaaaaactgaggactggatcgaccgcaccaaagagttcatcgtcaccactaaggtcctcaaaaacggcgaccttaagcggtcttacaaaacggtggactcggaaaaagactgggcagctatcaaagccaaaaccgaacaggacatcgaacgctccaacaaaacagtgggagagttcatctacgaaaccttactcgaaaaccccacccaaaagatccggggaaaactggttaaaaccatcgaacgtaaattctacaaagaggaactcaaaaacatcctaattaaacaaatagaactccaacccacactgttcagcgaagaactatacaaagcctgcatcgaagaactgtacccgagaaacgaggcccaccaaaatgccatcaaaaaccgggatttcatctacctactaatggacgacataatcttctaccaacgtcccctgaaaagccagaaaagtaacatctctggatgccagttggagcaacgcgtatactacaaagccaacaaagactccggcgaaaacgaagaggtaaaacaagccgtgaaagccataccaaagagccaccccctattccaagagttccgcaactggcaatggctgcagaacctaaagatatacaacaaagtggatacagaaaaaggcgaacttacggacgtcacgaaacaacttctcccgagtgaagactcctgggtcaacctcttcaactttctccaatgcaagaaggaactggaacaaaagcagttcattaagtacttcatcgacaagaaattgatcaacaaaaccgagaaagaccactaccgctggaactacgtcgaagacaagaagtacccgttcaccgaaacgcgcgcacaattcataagccgactcacgaaagtagaaggaatcgaagaaataaatactttcctagacaagaaaacacaaataggcactaaggacaactccccctttgtgtcccgcatcgagcagctatggcacataatctatagcgtctcagacatcaaggagtacgaatcagcactggaaaagttcgcgataaaacaccacctaaacgaggagtcgttcgtcgccaactttatcaaattcccacccttcaaatcagattacggatcgtactcgaagaaggcacttaacaagctcctacccctcatgcgtcgtggcaactactggaccgagaacgacatatcggagaaagtaaagctaagagtaagcgagatcatggaaagagtaaacgccctcaacctaaaggaagactactcatcaaaagagctggccgaaacactcgtcaacgtctccgacgacgacgtaaagaaacaacttataaagagcttcgtgagcttcaaagaccgcaacccactcatgggactcaacacgttccaggcgacgtatctggtttacggccgacactccgaggtgggcgacatacagaactggaaaacccccgacgacatcgacacataccttaaaaacttcaaacaacactccctacgtaaccccatagttgaacaggtagtaacggagacgctccgggtggtgcgagacatctggaaacatcacgggaaatcacagaccaacttcttcaacgaaatccatgttgaactcgggcgcgagatgaaaaacccggcggacaaacgaaagcggatcagcgaacgaaacaccgaaaacgaaaacacaaacaaccgcatccgagagattttgaaggacctaatgaacgacgcctcgatccagggagacgtgcgcgactactcaccttcccaacaagggattctaaagatatacgaggagggcgtctaccaaaaccccaaggtagactacagtaaagtgtccgaggacgagatcacgaaaatacgacgttccaacaaccccacccaaaaagaaatccaacgctaccgcctttggctggagcaggggtacatctcaccgtatacctgcaagccgatccccctcagcaaacttttcacacaccactaccaaatagaacacatcataccccagtcacgctacttcgataactcatcaagcaacaaaataatctgcgagtccgaagtgaacgaagacaaggacaacaaaacggcattcgagtacctaaaagataaaggggaaaacgtcataaacggtcacaaactcctttccctcgccgcctacgaagcacacgtaaataaatacttcaagaacaaccgtcaaaagttgaaaaacctcctatcagaagacatccccgaaggcttcattaaccgacaaatgaacgactcgcgctacatctccaagctagtcaaagggctactctcgaacattgtacgtgaagagggagagcaagaagtaacaagtaaaaacctaatccccgtcaccggctcagtaacatctaaactgaaaaacgattggggactgaacgacaaatggaacgaactcatccttcctcgcttcaaaaggctcaaccaactaacccagaccaacgactttacaacggcaaatacaaatggcaacacgatacccaccgtcccagacgaacttctcaaaggcttcagcaaaaagcgcatcgatcacagacaccacgcccttgacgccctggtagtcgcatgctgcacacgcaatcacagcaactacctctccgcgctaaacaccgaaaacaaaaactacggactgcgagacaagttgctcataaagaatgacaacgaccactacacaaaatccttccaaatgccctggcacggctttacaacagaagccaaaaatcaattggaggagacagtaatatccttcaaacaaaacctgcgagtgatcaataaggccaataacaaattctggtcctacaaagacgagaacgggaagttgaacctggacaagaatggaaaaccaataaagaaactcagaaaacaaaccaagggcgataactgggcagtccggcaacctctccacgaagaaacaatatccggcatagtcaatctcccctgggttaaggcagaaaaggaaaaatttacatacgccacccgcaagtcactggacaagagcttcgacctaaagaaaatcgagaaaatcaccgacactggtatccagaaaatactccggaactatcttatgcaagaaaaattcaaagaactcgacaagaaagacaaagaggtctacaactcggaactggcattctcccaagaagggctggaagatctaaacagtaacatcgagcaattcaacgaccaaaagccccacaagcccatctacaaagtcagactgttcgagaaagggagcggtcgcttcgccttaggtttcaagggaattaacgccaagaaatatgcccaaggttccccgaacttgtattttaatatatatcgcaacgaggacggccaatactacgagaccgtcccactcaacaaagttatcatccaccaaaagaacgccgcaaacatgccgaaaaagaaccgcacccccgtcccaatctcaaacacagccataaaccgatcgaaagaggttctagtggactacaaaatgaccctcagccccctagacctagtttatatacccaccgaagaggaattaaacaacataaactcactggacttcaataacctgtcaaaaagtcaacgcaaacgattgtacaacgtcaacgacttctcaggttacacaatttacttctcccctaacactcttgcgaaatcgatctgtccaaaggaagtagacatgaagttcgacgagaagaaacaaaaacccacgggtagcttcgacagcaaaaccgcttctctcgacggaatgtcgattaaagaacgttgcattaaactcatcatagaccggctcggtaacatcagtaaagcatga

SEQ ID NO: 6913 - RNA, 4539 nt, synthetic construct
  misc_feature 1..4539: note = Cas9 variant
  source 1..4539: mol_type = other RNA
atgaaaaagatactagggctcgaccttggcaccaactccattggttgggccgtcgtgaacgctgacgaaataactagggatgacggctcccgatatctgaagcccaatggaatcagcgccgctggcagtcgtatcataccgatgagcgccgacatcctcggcgacttcgaaaaaggcaacagtatctcccagacggcagagcgcacccggatgcgtatggcacgccgactccacgaaagagcactccttcgtcgcgagaggttactcagagtcctcaacctactagattttctcccgaaacacttcgcagacaagatcgacaggtatggaaagttcacagacgacagcgaacccaagctggcatggcgtaagaacaccgaaggaaagtacgaatttatcttccaagacgcattcaacgaaatgttagcagagttcaaagacaagcagccggaaatagtagaagagggaaagaaaatcccctacgactggaccatctactacttaagaaagaaggcccttgaaaaggcacttagtaaggaagaactctcatggatactactgcaatttaaccagaaacggggctactatcaactccgcggggaggaagaggagatcccgcaagacaagaaaatcgaatacctggcacaaaaggtggtcaaagtcgaggcaaccgaccaaaagaagggcgacgacgtctggtacaacgtctacctggagaacggtatgatctaccgccgaacctcaaaagccccactcgactgggaaggcaaagtcaaagagttcatcgtcacaacagaagtggaaaacgacggggaaaccccaaagaaggacaaagaaggcaacatcaaacgctcattccgcgcaccaaaggaagacgactggacccttctgaaaaagaaaacggaggcggacatagaaaacagtcacaaaaccgtcggatgctatatctacgactccctactaaacaacccgaaacagaaaataattggcaaacttgtacgcaccgttgagcgcaaattctacaaagaagaactcacccaaatccttaaaaagcaagtagagctcattccagaactacgcgacgacaatctatataaacaatgcatcgaagaattataccccataaatgaggcgcaccgaaacaccatagcgaaaacggacttcgcaaatctattcatcaatgacatcctattttaccagcgccccttaaaaagcaagaagtcacaaatagataactgcccctatgaggaacgtatattcatcgatagcaagaccggagagaagaagaaagtccctgtaaaatgtatcgcgaaatcaaacccactattccaagaatttcggctgtggcaattcatccaaaacctgcgaatataccaaagggagaaagagatagacgggaaactactgaccgacatagacatcacctcagagtgcctgaaatccgaggaagattacgtgcgcctcttcgactggctgaacgaccgggaaacaatagaacaggaagacctactgaagcacctattcaacaccaagaaatcaaagaacaaggaaaacccgtaccggtggaactacgtagaagataaggtatacccgtgcaacgaaaccagagcaacgatcctcaaaggcttctccaagtgcggaattaatgcatccgtgctaagtccagagctggaaatggccctatggcacatcctatatagcgtagaggacaagaaggaaatagaaacagcactaacccactttgcgcaaaaacagggttggaatgacgacttcgcaaaggtcttctcaaaagccaagccgttcaagaaagactacggttcgtactccgaaaaagcgataaagaagctgttaagcctgatgcgtatgggcaaatactggaaccaagataacatcgacaaaaacacgttagacagaatagacaagataatcaacggagaatacgacgaaaagatctcaaaccgcgtccgggacaacgcaatcaacctaaaagacatatctgattttcggggcctaccggtctggctggcgtgttacatcgtgtacgaccgccactcagaagcaaaagactgcactaagtggaactccccggaggagatagatagctacctaaagaaattcaaacaacactcgcttcgaaaccccatcgtggagcaggtcgtaacagaaacgctccgcacagtcagagacatctggatccaagaggaacagatcgacgaaatccacctcgaactgggccgcgacctaaagaacccagccgacaaaaggaaaaagatgtcggaaaatatactcaaaaacgagaacacaaacctaagaataaaggccatgctaatggagttcatgaacccctcgatgggcatagaaaacgtccgaccctacagtccctcacaacaggacatactccggatctacgaagagaacgcactagacaacctgaccaaagacgacaaggacttcgacttcatttcaaaaatctccaagcaagcccagcccagcaaaacagacattatccggtataaatgctggctagaacaaaagtataggagtccatacactggcaaaaccatttccctcagcaaactcttcaccccggcgtacgaaatcgaacacgttataccacaaagcctctatttcgacgactcgttctcaaacaaggtaatttgcgaagcagaagttaacaagctcaaggatagacaactaggatacaaattcatcgcggaacaccacggtgagaaagtacagctttcgcaaggagaggtggtcgaaatcttaagcgtcgacgcctatgagaaattcgtaaaagagaactacgccaacaaccggatcaaaatgaaaaagctgctcatggagagtatacccgacgagttcatagaacgacaactaaatgacagtcgctacatctccaaagtggtgaaaggtttattgagtaatatagtacgtgagaaaatcgacgacgaaaattacgaaccagaagcggtgtccaaaaacctcataagctgcaacggcgccataactgatcgactcaagaaagactgggggatgaatgacgtatggaactcgatcatactgcctcgattcatacgaatgaaccaaatcacaggcaaagactgcttcaccacaacgaacgccgagggccaccttattccgcagatgcccttagagctacagaaaggattcaataagaagcgtatcgaccacagacaccacgcgatggacgccatcgtcatagcatgcactacgagagaccatgtcaacctcctcaacaacgaagcggcccacagcaaattcaacgccacgcgataccagctacagcgaaaacttaggcgattcgaaaaggccgtcatagacggaaaggaacgggaagtcgccaaagagttcctaaaaccatgggactcgttctccagcgactcgaaaaacatattagaaaacatcatcgtttcattcaaacaaaaccagagagtcataaacaagacaaccaacgcctttttgcacttcgacgagaacgggaaaaagacgttcatcaagcagggcaagggcgacagctgggccatacgaaaaagcatgcacaaagacacagtattcggcgaaatcaacctccgcaaagtcaggtctgtatcactcaacgaagccataaaagtaccagaacgagtactgaacaagaaaatcaaagagaaaatactcgaactcaagaacaacaaaatcgatgccaaaaatatcaaaaagtacatagaagaaaaccacacgggaggctacggaatcgacagctcgaaaatcgacgtcttctacttcaccaaagaaacaaaggagcgattcttcgcaacaagaaaaacgctggacacgagcttcaaccaggcaaaaatcaaagattcgatagctgacagcggaatccaaaagatactgctagcacacctcaagtccaaaaacggcgatgctgagcaagccttcagccccgatgggatagacgagatgaacaagaacatagttgaactcaacaacgggaagttccatcagccaatcctaaaagtccgggtgtacgaaaaagccgacaaattcgccgtaggacaaaaaggcaacaagaaggtcaaattcgtagaggcagccaaaggaaccaaccttttcttcgccatcttcgagaaagacggcaaacgctcatatcttaccattcccctgaatgtcatgatcgactgccagaaacaatacggcaaccaatggaagaacaacatcgaggcctaccttaaagaaaaagagctagtcgaaaaggacgtcaaactccaattcatactcagcccaaacgacctggtgtacctccccacggaagggagcatagacaagaaacgcatctacaaagtcgtctccttcaccaacaatcggctatacgccatcccctacgcgatcgcaaaaagcatcgttgacaaaaacgagttcacacaactgaacaaaatagagttcaccgacaacaaagaatcaatcaaagacgcctgtgtaccagtcatcatcgacaggctaggcaacgtgatagagttcaacggaaaacgcctatga

SEQ ID NO: 6914 - RNA, 4539 nt, synthetic construct
  misc_feature 1..4539: note = Cas9 variant
  source 1..4539: mol_type = other RNA
atgaagaacatactcggactggacctcgggacgaacagcatcggttgggccgtaatcaactcagaagaagacggcccaatcgtcaagaagcgcatcgaattagccggcagcagaatcattccgatggacgccgcagtcctaggcaacttcgactcgggggtaacaaagtctcaaacggcggaacgaacgagcttccgctcaatccgccgcctccgcgaacgacaactcctccggcgggaacggctgcacaaagtgcttcagatactaggcttcctgcccgaacactacgtaaacgacatcgacttcgaaaaccaccctgggaagataaaacgtaacacggaacccaaactaccgtggcgaaagaacagcatgggccaattcgagttcattttccaagactcgttcgaggcaatgttgaccgacttcgcgacacaccaaccagtcttcgtaagcgaagggaagaaagtcccatacgactggaccctatactacctccgtaagaaagccttaacagaaggtatttctaaagaggaactggcctggcttattctcaacttcaatcaaaaacgaggatactaccaactgcgcggcgaagaggaagaggaacagtcgaacaaactggtggaattttacgcactgcgcgtggttaaagtggaagcaactgacgacaagaaaggcaaagacacgtggtataacgtgcacctcgaaaacgggtggatatatcgccgaacgagcaacattccactggactgggaagggaaggtaaaagagttcatcgtcacgaccgacctaaatgaagacggtacccctaaactagataaatacggggaagttaaacggtctttccgtgccccgaaagaagacgattggactctaataaagaaaaagacagaatccgacatcgccaacagtcacaagacagttggatgctacatatacgacgcactcctccaaaacccccaccagaagataaaaggccgccttgtgcgcacagtcgaacggaagttctataaagaagaacttcgactcatcctggaaaaacaactgtcgttccacccagaactgcaagaccgagacctctaccgggcatgcatcgacgccttatacgtctcaaacgaagctcataaaaataacatatccggcagggacttcgtgtacctgttcatagatgatatcatcttctaccaacgcccactcaagaccaagaaatcactcatcgacaactgtccctacgaagaaaaccagtatatggacagagaaactggcgaagtcaaacaagcccccataaaatgtatagcaaaatcgcatccattatttcaagagttccgcctctggcaattcatcagtaatatcaggatataccaacgagaacgagtcctcgacgacggcaaactagaaaccgatgtcgacgtgacaccggatttcctgaaaaccgaagacgactacactaccctattcgaatggttcaacgatcggaaagaagttgaccaaaaagcattcctcaaaaaccctcaattcggattaaagaagaccttcacagaataccgctggaactacgtcgaggacaaatcctacccctgcaacgaaacgcgcaacgcgatactgaacggactccagaaagctggagtctccgcagacttcctaagccgcgaagtagaggaggctctatggcacatactctactcagtagaagacaagatcgagatagaatccgccctacgcaaattcgccagcaagcacgacctcgacgaccgattcgcagatgtcttcaagaaactgcccccgtttaagaaagaatacggcgcatacagcgccaaagcgataaagaaactgcttccgctgatgagaatcggcaaatactgggaactgtctaacatcgatgacaaaaccaaagagcgcatcgacaagatcataacaggcgagtgggacgaaaacatacacgacagggtccgcgaaaaagcaatcaagctatccgacatcaccgacttcaaaggcctcccactctggctgtcatgctatgtcgtctacaacagacacagcgaggcacgggcaatagccaagtgggagtcccccgaagacatcgactcatacctgcgcttgttccggcaacacagcctaagaaaccctatcgtggagcaggtaattaccgaaacgctacggactgtcagagacatctggaagcgggtaggacaaatcgatgaaatacacgtcgaacttggccgagagatcaagaaccccgccgacaaacgcgcgaaaatgaccgcccagattgtcgaaaatgaaaacactaacctacgaataaaggcactactcgcggagttcattaactccgaatacgagatcgagaacgtcaggccctactcgagcaatcagcaagaaaaactcaaaatatacgaggataccgtgctgaacggagttaaagaaatcccggaagacataaacaccattctaaagaaattccgcgaatccgacctcaagaaacgccctacaaaaagcgacttcctgcactataagctgtggctagagcagaagtactgttctccatacaccgggcgtatcatacccctcggcaagttattcacatccgcctacgagatagaacacataatcccccaggcgcattacttcgacgacagcttctcaaacaaagtcatatgcgaggctgaagtaaacggcctgaaagacaaaaagctcggatacgagttcatcaagcacaaccccggcaaaatggtcgaaatcggattcgggaaacctcccgtccgaattttctcggtcgaggaatacgaaagattcgtgaaggagaactacagcggaataaagaacaagatgaacaaactactgatggatgacatcccagaaacattcatcgaacgccaactcaacgacagccgctacatttcgaaggtggtcaaaagtctcctatcaaacatagtgcgggagaaagactccaacggcgaatacgaaccggaagcaatcagcaagaacgtaatcgtatgcacaggctcggtcacagaccgcctcaaacgcgactggggcgtgaacgacgtctggaactccataatctacccccgcttcgaacgcctgaacgaactgaccggttctcaacaattcggctgctgggaaaacaaagaagggaaaagagtgtttcaaacagctgtgcccctagaaatgcaaaaaggctttagcaagaaaagaatagaccaccgccaccatgccatggacgcaatcgtaatcgcctgcgccacacgaaaccacataaactatctaagtaacgagtccgcctcaaagaaggccaagatctctcgaactgacctacaacggctcctgtgcaccaaatgcaggacagacgacaacgggaactataagtggatagtcaagaaaccatggccagccttcacgcaagacatacgcaaagccctcgaaaacattaccgttagctttaaacagaacctcagagtcatcaacaaaaccaccaactactacgtacacttcgacgaatcaggcaagaaagttctagaaaaacaaattaacggtgacagctgggccatcaggaaacccatgcacaaagacaccgtcttcggaaaagtaaacctgcagaaagttaaggaagtccgcttgagcctcgccctcgacacgccaaaaatgattgtcgacaagaagctcaaagaaaaggtcctccaactttacagctacaagtacgacaagaaacgaattgataagtactttaaagaaaatgccagcctttggaaggatctcaatctctccaaagtcgcagtctactatttcacaaacgactccaccgaacccctagtcgcggtcaggaagccactcgacacatcctttaacgcaaagaaaataaaagaatccgttacagataccggcattcagaaaatactcctcaaccacctaagcaacaaccaagatgacccaaacttagcattctcgccagacggaatcgataaaatgaacaagaatctgaccgccctcaacgacggcaagtaccaccaaccaatctacaaagtgcgcgtctgtgaaccccaaggaaataagttctcagtcggcacaagcgggaacaaaacctccaaatacgtagaggcggccaaaggaactaaccttttcttcgcagtctatcaaacagaagatggcaaacgatcgtacgagacaataccactgaacgtagtcatagagcgcgaaaaacttggctggactcccgtgcccgagaacaacaacaacggcgacaaactcctattctggctaagccccaacgacctcgtctacgtacctaccgcggacgaactcaacaacggtatgcgcctcgataacatggacaaagggcgtatctacaaaatgatcagctgcagcggaccacagtgcttctttataccccagaatgtgagcaacgcaattatcccagtaatcgaattgggcgccaacaataaggcggagaaaagctggaacaacgaaatgatcaaggtggtctgcgtaccgatacgtgtagaccgactcgggtgcataacacaaatcaacaaccaaaaatga

SEQ ID NO: 6915 - RNA, 4551 nt, synthetic construct
  misc_feature 1..4551: note = Cas9 variant
  source 1..4551: mol_type = other RNA
atgaaaaacatcctaggccttgatctgggtacaaactcgatcggatggtccgtgatacaagagaaacacaacgagaacaacgaatgccaaaaattaatactcggcgcgggctccagaataatcccaatggacgcagctgtgttaggcgactttgcaaaagggaacaccatcagtcaaaccaaggaccgaacccaataccgaggagtaagacgactccgagagcgatgtcttctccgccgagagcgcctattccgggtcctcgatataatgggattcttgccccaacacttcagcaatgcactcaccagatacgggaaattcaaagatgccgatgaagaacccaaaatagcttggcgaaaagacgacgaaggcaagatgcacttcctattcgccgattccttcaatgaaatgatcgaagagttccgttctgttcaacccgaactccttaaacgtggcatgaaggtcccttacgattggaccctatactacctccggaaaaaggcaatgcgcgaggcggtaacaccttttgaactagcgtggctcatactttcattcaaccagaagcgcggatattaccagctacgcggcgaggaagaaggagaggcagacaactcgaaatccgaggaatacctagcccaacgagtggtcgacgtcatagacaccggcgaaaagaaaggcaaatccacctggtttgatatcgtattagaaaacggtatggtctaccacagaccagcagaaataaaacctgactggataggaaaaacaaaagagttcatagtcacaactcaattcgacaaagacgggaacccaaagaaagacaaagaaggcaacgtcaagatgtccttcagaatgcccaacgaaaacgactggaacctgcagaaaaagaaggccgaaaaagacatcgacgaatcaggtatgacggtaggcgaatacatctacaacgcactcctacacaacccgaagcagaaaataaagggcaaactcgtacgagtcgtcgaaagaaaatactacaaaaacgaactgcagaaaatcctagaatcccagaaaagatttatcccgcaacttagcgactccgcactctacgaaaaatgtataaaagagctctaccaatcaaacgaagcgtaccgaaacagcatatcaaccagaaacgacttcacatacctattcgtcgacaacatcatcttctaccaacgtccattaaaaagcaagaaatccctcatagataactgcccgtacgaatccctcgcatacaccaaggatggggaagaacataaggccccggtcaagtgcatcgccaagtcccaccccctttaccaagagttccgactgtggcaattcatctcgaacctaagaatctaccaacgccaaaaacaagtgggggataaagtaaaactcgacgtcgacgtaacagatgagttcctcccaacagacgacagacgagagagcttattcgattatctgaacgacaagacagaaataaaacaagacgtactgttaaaggagttcttctccatgaagaaaccaaaaggcaaagacagcgtgtatccctacagatggaactacgtcgaagacaaaagctacccatgcaacgtaacaaggggaaagatactagccaagctcaatagagccggaatctccgcagacttcctgagctcgaacggcaatgaagaaagtctctggcacatcctgtacagtgtcgaagacaagggcgaactccggaaggcactagcaagattcgcggccaaaaacggcctggacgacgcattcaccgaagctcttgctgacatcgaaccttataagaaagaatacggggcatactccgcaaaggcgctcaagaagctactgccactaatgcgacttgggaaatactggaactacgacaacatcgcgcctgcgacaaaggcgcggatctcgaagataatagacggagagtacgacgagaacatacgcaacagagtaagggagaaggcaatgtcgctcaactcagcaagccaattccaaggcttgcccctctggctcgcctgttacatagtatacgaccgacactccgagcgggcggactcgggccggtggtcatcccccgaagacatagacaaatacctaagcgacttcaaacaacattccctacggaacccaatagtcgaacaagtcgtgacggagacgctacgcacggtccgcgacatatggaaaaggtacggagaaattagcgagatacatgtagaactcgggcgagagatgaagaaccccgcagacaaacgctccaagatgaacagaaggatgctagaaaacgaaaacgccaacatgcgagccaaactactactcaccgagttcatgaatccggagttcggtatcgaaaacgtccgcagttactcaccaagccaacaagaactcctcagaatctacgaagatggagcaatcagcaacgccggcagcgaaatcgacgatgaaataagcgacatcatgtcaaggctaagccaagtagacgtcaaaaagcagccaacggcatctgaagtgaaaaggtatatactctggctagaacaaaactacagatcaccctacaccggccagatgattccgctcgcaaaattattcacgccagcatacgaaatcgaacacgtaataccccagtccaggtacttcgacgacagctttagcaacaaggtcatttgcgaggccgaagtaaacaaactaaaagaccgaatgcttgggtacgagttcatcaaacaacacaagggcgaaaaagtgtcactctcaatgggcggaaccgtagaaatcctcagccccgaggaatacgttcggcacgtggaatcccaatacaaaaacaacaaagccaaaatgcgaaaactactcatggacgacataccagacgagttcataaaccggcaactcaacgacagcagatatatcagcaaactgataatctccctcctgtcaaacatcgtccgcgaagaaggcgaagaagaagccaccagcaaaaacgtgatctcctgcaacggaagcataacagacagactaaagaaggactgggggataaatgacgtgtggaaccatataatactcccacgcttccgacgcctgaacgagctaactggcaccgacaaattcactacgtccaataaggaaggccacgaggttccagaaatgcccctcgagctccagaagggattcaacaagaaacgcatagaccaccgccaccacgcaatggacgccatcgtaatcgcatgcataacgagagatcacgtgaaccttctcaacaacgaggcagcgatgtcgaaaaacaatgcaaaccgcatccagctctccaaaaagctgagacgctacgaatctgtggagatagaaaaggatggcatccgaaaacaaatctcgatggccaaagagttcaagaaaccctgggaaggattcacagctgacgtagagaggaccctgagggacatcgttgtctccttcaaacagaatcttcgtgtcatcaacaagacaacaaactactaccagcacttcaaggacgggaaaaagatatactcgccccagtccaaaggagacagctgggcaatccgcaagtccatgcacaaggagacagtattcggagaaatcaacatcagacggatcaaagaggtctccctaaaagaggccatgaaaagaattaaagacatcgccgacaaagagctccggtccaagatcgtcgaactaatggcgctacaatacaatgaaaagaagataaagcaatacttcagcgacaacaaggacgagtggagtgatgtcaacccaaagaaaataaaaatccactatttcacaaaagagaccaacgaacgattcttcgccacccggaaacccctagacacgtcattcgacaaaaagaaaataaaaacccaagtagcagacaccgcgatccagaaaatactcttaaatcacctgtcagcacacggcgataaagcagagacagccttctcacccgacgggatagatgaaatgaaccgtaacattatcgaactcaacgacggcaaattccaccaacccatcctaaaagtgagaatatatgagaaagctgataaatacgcagtaggacaacagggcaacaaaaagaagaaatacgtagaagcagccaaaggaacaaatctcttcttcgcaatttacgctgaagagaaaatcgacgagaaaaccggcgacacagtcatcacaagaacctatgacagcatacccctaaacgtcgtcattgacagagaaaaacgaggactcagcccagtcccagaaaacgaaaacggcgccaagccgaagtacgtgctctcaccaaacgacctggtatacgtacccaacgaagaagaacgtgagacgggacgaatctgcgaaccgctcgacaaagaaagaatatacaaaatggtgagctcaaacaaaaagcaggccttcttcataaaaagtgaagtcgcctcgaccattgtggacaaattcgagttctcagccctgaacaagcaagaacgcgccctgtcaggagaaatgatcaaagaaatatgcatccccatcagcattaaccgcataggcgaaatcacgctgagatga

SEQ ID NO: 6916 - RNA, 4554 nt, synthetic construct
  misc_feature 1..4554: note = Cas9 variant
  source 1..4554: mol_type = other RNA
atgaagaaaatcgtaggcctggacctcggaaccaactccataggatgggctctcatcaacgcatacatcaataaagaacacctctacggaatagaagcatgcggttcgcggataatacctatggacgcagccatactgggcaacttcgacaaaggcaactcgatctcccaaacggcagaccgaacaagttacaggggtatccgccgactccgtgaacgccacctcctcaggcgcgagcgcctgcaccgaatactggacttactgggctttctgcccaaacattactcagacagtctgaacagatacggcaagttcctgaacgacattgagtgcaaactaccctgggtaaaggacgagacaggctcttataaatttatcttccaagagtccttcaaagaaatgctcgccaatttcacggagcaccaccccatcttaatcgcaaacaacaagaaagtcccatacgactggaccatctactacctacggaaaaaggccctcacccaaaagatatcgaaggaagaactagcatggatcctcctcaacttcaaccaaaaacgaggatactaccaactgagaggtgaggaggaagaaacccccaacaagctcgtcgagtactactcgctcaaagtagagaaggttgaggatagtggggaaaggaaaggaaaagatacatggtacaatgtccacctagagaacggcatgatatacagacgcacctcaaacataccgctcgactgggaaggaaagacaaaggagttcatagtaaccacagacctcgaagcggacggctcgccaaagaaggacaaagaaggaaacatcaagcgctcatttcgagcaccaaaagacgacgactggacccttataaagaagaaaactgaagccgacatagacaagattaaaatgacagtcggcgcctacatatacgacacgctactccaaaaacccgatcagaaaatcagaggcaaactcgtcagaaccatcgaacgaaaatactataaaaacgaactataccaaatcctaaaaacccagagcgagttccacgaggaactaagagacaagcagctttacatcgcctgtctgaatgaactctacccaaacaatgaaccgcgaaggaactccatttcaacacgcgacttctgccatctattcatcgaggacatcatcttctaccaacgcccactcaaatctaaaaagagcctgatagataattgcccctacgaggaaaacaggtacatcgacaaagaaagtggcgagataaaacacgcgagcatcaaatgtatagcaaaatcacaccccttataccaggagtttcgactttggcagttcatcgtcaacctacggatctatcgtaaagagacagacgttgatgtgacgcaagaactcctcccgacagaggcagactacgtgacgctctttgaatggctaaatgaaaagaaagaaatagatcaaaaagcattcttcaaatatcccccgttcggatttaagaaaaccacatcgaattaccgttggaactacgtcgaagacaagccatacccatgcaacgaaacgcacgctcaaatcatagccaggttaggaaaggcacacatcccgaaagccttcctcagtaaagaaaaggaggaaacactctggcacatcctatactcaatcgaggacaaacaagagatcgaaaaggcgctccacagcttcgccaacaagaacaacctcagcgaagagttcatcgaacaattcaaaaactttccacccttcaagaaagagtacggcagctactccgctaaagccatcaaaaagctgctacccctcatgcgtatgggcaagtactggtccatagaaaacatagacaacggcaccaggattcggatcaataagattatcgacggggagtacgacgaaaacatccgcgaacgagtccgccaaaaggcaatcaacctcacagacatcacccacttccgcgccctgccgctatggctcgcatgttaccttgtctatgatcgtcactcggaggtgaaagacatcgtgaagtggaaaacccccaaggacatagacctgtacctcaaatccttcaaacagcactctttgagaaatcccatcgtcgaacaggtcatcacagaaactctccgaaccgttcgagacatatggcaacaagtgggccacatcgacgaaatccacatcgaattaggccgagagatgaagaacccggcggacaaacgggccagaatgtctcagcaaatgatcaaaaacgaaaataccaacctacggatcaaagcgctcctcactgagttcctaaaccccgagttcggtatcgaaaacgtacgaccctacagccccagtcagcaagacctgctccgcatctacgaagaaggcgtccttaacagtatcctcgaactaccagaagacatcggcataatcctgggcaagttcaaccaaacagacaccctcaaaagacccacccgctccgaaatactccgttacaagctctggctcgaacagaaatacagaagcccatacacaggagagatgatccccctttcgaaattgttcacgccagcatacgaaatcgaacacataataccacagtcgagatacttcgacgactcactcagcaacaaggtaatctgcgagtcagaaatcaacaagctaaaagatcgatcactaggatacgagttcatcaagaaccaccatggcgaaaaggtggaactcgcattcgacaaacccgtggaagtcctcagcgtagaagcctacgagaagttagtccacgagagctactcgcacaaccggtccaagatgaagaaactccttatggaggacatcccggaccaattcattgaacggcaacttaacgattctcgatacatcagcaaagtagtgaaatcactattgtcgaatatcgtcagagaagaaaacgaacaggaggcaatatcgaagaacgtcatcccatgcacaggcgggataaccgaccgactgaagaaggactgggggatcaacgacgtatggaacaagatcgtgctgcccaggttcatcagactgaacgaacttaccgagtccacccgcttcacctcgatcaacaccaacaacacgatgattccgagcatgccactcgagctgcagaaaggcttcaataagaaacgcatcgaccacaggcaccacgcgatggacgcaataatcatagcatgcgccaaccggaacatagtaaactacttaaataacgtgtcagcctccaaaaacactaaaatcacccgcagggacctacaaacactcttgtgccacaaggacaagaccgacaacaacggaaactacaaatgggtgatcgacaaaccctgggagaccttcacacaagacacgctgacagcactccagaagatcacagtttccttcaaacaaaacctccgagtcataaacaaaacaactaaccattaccagcactacgaaaacggaaagaaaatagtaagcaaccagtcaaaaggcgatagctgggcaataagaaaaagcatgcacaaagaaaccgtgcatggggaagtcaacctgcgcatgataaaaacagtctccttcaatgaggccctcaaaaagccccaagcaatcgtcgagatggaccttaagaagaaaatcttggccatgctagaactgggctacgacacaaaacgtatcaaaaactacttcgaggaaaacaaagacacctggcaggacatcaacccctcaaaaatcaaggtgtactacttcacaaaggaaacaaaggaccgctacttcgcagtccgaaaaccaatcgacaccagcttcgataaaaagaaaataaaagagtcaattacagacacaggcatacagcaaatcatgctacggcacctcgaaacaaaagataatgatcccacactcgccttctcacccgacggaatcgacgagatgaaccgcaacatcttaatcctaaacaaaggtaagaaacaccaacccatatacaaagtccgcgtttatgaaaaagcggaaaagtttaccgtaggacagaagggaaacaagcgaactaaattcgtggaggccgccaaaggcactaacctatttttcgcgatctacgagacagaagagatagacaaagacacgaaaaaggtaatccggaaaagaagctactcgacaatcccgctgaacgtcgtcatagaaaggcagaagcagggactttcctccgcgcccgaagacgaaaatggcaaccttcccaagtacatactcagcccaaacgacctagtgtacgttccgacacaagaagagataaacaagggagaagtagtcatgcccatcgatcgtgaccgcatctacaagatggtggacagtagcggaataaccgcgaactttatcccagccagcaccgcgaacctgatcttcgccctacccaaagccacggccgaaatctactgcaacggcgagaactgcatacaaaacgaatacggcatcggcagtccccaatccaaaaaccaaaaggcaatcacaggtgagatggtaaaagaaatatgctttccaatcaaagtcgaccggttaggaaacatcatacaggtagggagctgcattctgaccaactga

SEQ ID NO: 6917 - RNA, 4563 nt, synthetic construct
  misc_feature 1..4563: note = Cas9 variant
  source 1..4563: mol_type = other RNA
atgaagaaaatagtgggcctcgacctaggcaccaactcaataggctgggccctaatcaacgcctacatagacgaatataacaaagaacacctctacgggatcgaggcatgtggatcccgaatcatcccaatggacgcagccattctaggcaacttcgacaagggaaactccataagccaaacggcagaccgaacatcataccgaggcatcaggcggctccgggaacgccatctgctacggcgcgaacgccttcaccgcattctcgacctgttaggcttcctaccaaaacactactccgatagcctcaaccgctacggcaaattcctaaatgacatagaatgcaaactaccatgggtaaaggacgaaaccggctcatacaagtttattttccaagaatcgttcaaagaaatgttagccaacttcactgaacaccacccaatacttatagcaaataacaagaaagtgccctacgactggacaatctactacctccgaaagaaggccctcactcaaaagatcagcaaagaggagctcgcctggatcctcctaaacttcaatcagaaaagaggatattatcaactccgaggagaagaggaggaaacacccaacaaacttgtcgaatactacagtctcaaagtcgaaaaagtggaagactccggtgagcgcaaaggaaaagacacgtggtacaacgtgcacctggagaacggcatgatctaccgaaggacctcaaacatcccactagattgggagggcaaaaccaaagagttcatcgtaaccaccgacctcgaagcagacggctcccccaagaaagacaaggaaggcaacatcaaaagatcgttccgcgcacctaaggacgatgactggacgctgatcaagaagaaaactgaggcagacatagacaaaattaaaatgacagtaggggcctacatatatgacactctcctccaaaaaccggaccagaaaatacgcggtaaattagtgcgaacgatagagcggaaatactacaaaaacgagctctatcaaattctaaaaacgcaaagtgagttccacgaagaattaagagacaaacaactatacatcgcgtgcctcaacgagctctaccctaataatgaaccgcgccgcaacagcatatcgacccgggacttttgccaccttttcatcgaagatatcatcttttaccaacgcccactaaaaagcaaaaagtcattaattgacaactgcccctacgaagaaaaccggtatatcgacaaagaatcaggcgaaatcaagcacgcctccataaaatgcatagcaaagtctcacccactataccaagagttccggctttggcagttcattgtgaaccttcgcatctaccggaaagagaccgacgtagacgtcacacaggagctcctgcccaccgaagcagattatgtcaccctgttcgaatggttgaatgaaaagaaagagatcgaccaaaaggccttcttcaaatacccacccttcggatttaagaaaacaacgagcaattaccgctggaactacgtcgaggataagccgtacccatgcaacgagacgcacgcccaaatcatcgcgcgtttaggcaaggcacacatccccaaagccttcctcagcaaagagaaggaagaaacattatggcacatcctatatagtatcgaggacaaacaagaaatcgaaaaagccctacacagctttgctaacaaaaacaatttatccgaggagttcatcgaacaattcaaaaacttcccgcccttcaagaaagaatacggatcctacagcgcgaaagccatcaagaaactcctacccctaatgcggatgggcaaatactggagcatagagaacatcgacaacggcacaagaatacgaatcaataaaatcatcgatggagaatacgacgagaacatacgcgaacgggttcgccagaaagcaattaaccttaccgacatcacccacttccgcgcattaccgctatggctagcatgctacttagtatacgacagacacagtgaagtcaaagacatcgtaaaatggaaaattccaaaagacatcgacctctatctcaagtcattcaagcagcatagtctccgcaatcctatagtagaacaagttataaccgagaccctccggactgtgcgagacatatggcagcaggtcggtcacatcgacgagatacacatcgaactcggccgcgaaatgaagaacccggctgataagcgcgcacgcatgtcccagcagatgatcaagaatgagaataccaacctccgcatcaaagccctgctaacagagttcctcaaccccgagttcggaatcgaaaatgtgcgaccatactccccctcccaacaggacctccttcgcatctacgaagaaggcgtcctcaactctatcctcgaactgccagaagacataggaatcatcctcggcaaattcaaccagacagacacactcaaacggccgactcgctccgagatcctccgttataaactatggctagagcaaaaataccgtagcccctataccggtgaaatgatacccctctcaaaactattcacccctgcgtacgaaatcgaacacatcatacctcaaagccgctacttcgacgactccttaagcaacaaagtcatctgcgagtcagagatcaacaagctgaaagaccggtcactcggctacgaatttattaaaaaccaccacggtgaaaaggttgagctcgcgtttgacaagcccgttgaggtgttaagcgttgaggcatacgaaaagttggtacacgagtcctactcacacaaccgaagcaagatgaagaagctcttaatggaagatattcccgaccaattcatagagcgccagctgaacgactcccgctacatatcaaaggtcgtcaagagcctcctctcaaacattgtacgcgaggagaacgaacaagaggccatcagcaaaaacgtaataccatgtaccggagggataacagaccgactaaagaaagactggggaattaacgatgtatggaataaaatcgtcctaccccgatttatccgactgaacgaacttacagaatcaacccggtttacctccatcaacaccaacaacactatgatcccttcaatgccactggagctacaaaagggcttcaacaagaaacgaatcgaccaccgacatcacgccatggatgcaattataatagcatgcgccaacaggaacatagtcaactatctgaataatgtgagcgcatccaaaaacacgaaaataactcgcagagacctccaaacactcctctgccacaaagacaagacagataataacggaaattacaagtgggtcatagacaagccgtgggaaactttcacccaagacacgcttaccgcacttcagaaaataactgtttcattcaaacaaaacctgagagttatcaacaagaccacaaaccactaccaacactacgaaaacgggaagaagatagtgtcgaaccaatccaagggggacagctgggctattcgaaaaagcatgcataaagaaactgtacacggagaagtcaatctccgcatgataaagacagtgagcttcaacgaagccctcaagaaaccccacgccatcgtcgagatggaccttaaaaagaaaatcctcgccatgttggagctgggttatgacaccaaacggatcaaaaactacttcgaagagaataaagacacctggcaagatatcaacccctcaaaaatcaaagtctactacttcaccaaagaaacaaaagatagatactttgcggtccgcaaacccatcgacaccagcttcgacaaaaagaaaataaaagagagcataaccgacacaggcatccaacagatcatgctccgtcacctagagaccaaagacaacgacccaaccctcgcgttctcccccgacggcatcgacgaaatgaacagaaacatcctaatcctcaacaaaggcaagaagcaccaacccatctacaaggtaagggtctacgaaaaggcagagaagttcaccgtcggccaaaaaggtaataaacgaacaaagtttgtcgaagcagcaaaagggaccaacctcttcttcgcaatctatgaaacggaggaaatcgacaaagacaccaagaaagtgatacgcaaacgaagctacagcactatcccactcaacgtagtcatcgagcgccagaaacaagggctctcgtccgctccagaggacgaaaacggcaacctacccaaatacattctcagcccgaacgacctcgtatacgtccccacgcaagaggaaatcaacaaaggcgaagtcgtcatgcccattgaccgggaccgcatatacaagatggtagattcaagcggaatcaccgccaacttcatacccgcaagcaccgcgaacctaattttcgcgctaccaaaggcaaccgctgagatttactgcaacggagaaaactgcatccaaaatgaatatgggataggctctccacagtcgaagaaccaaaaagctataaccggtgaaatggtcaaggagatatgtttcccgattaaagtagacaggctcgggaacattatccaggtcggatcctgcatactcacgaactga

SEQ ID NO: 6918 - RNA, 4563 nt, synthetic construct
  misc_feature 1..4563: note = Cas9 variant
  source 1..4563: mol_type = other RNA
atgaaaaagatcgtaggcctagacctcggcacgaacagtatcgggtgggcgcttatcaacgcatacatcgacgaatacaataaagaacacttgtacggcatagaagcctgcggatcacgcatcatcccgatggatgccgcaatcctcggcaacttcgacaaaggaaattccatcagccaaacagctgaccgcacctcataccgagggataagacgactgcgagaacgacacctattaagaagagaacgcctccaccgaatactcgaccttctaggtttcctccccaaacactactccgacagcctgaacagatacggaaagttcctcaatgacatagagtgcaaactcccctgggtaaaagatgaaacagggtcctacaagttcatattccaggaatcattcaaagagatgctcgcgaacttcaccgaacaccaccccatcctaatcgccaacaacaagaaagtgccatacgactggacaatctactacctccgcaagaaagccctcacgcagaaaatctccaaagaggaactcgcctggatactcctcaacttcaaccaaaagcggggctattaccaactccgtggagaagaagaagaaacgcccaacaaactcgtcgaatattactcactgaaagtagaaaaggtagaggactccggcgaaaagaagggaaaagacacatggtacaatgttcacctagaaaacggaatgatctatcgacgaacctccaacatccccctcgactgggaaggtaaaacgaaggagttcattgtcactaccgacctggaagccgacggcagccccaagaaagacaaagaaggaaatatcaagcgcagcttcagagccccaaaagacgacgactggactctaataaagaagaaaacggaagcagacatagacaaaataaaaatgacagtcggagcctatatctacgacaccctcctccaaaaacccgatcaaaagatccgaggaaaattagtcagaactatcgagcgaaagtactataaaaacgagctttatcaaatcctaaaaacacaatcagagttccacgaagaactgcgtgacaaacaactgtacatcgcctgcctgaacgaactgtaccccaataatgaaccacggcgtaactcgatctcaacaagagacttctgccatctcttcatcgaagacatcatattttaccaacgcccactaaagtcaaagaagtccttaattgacaactgcccctacgaagagaaccgctatatagacaaagagagcggcgaaataaagcacgccagcatcaagtgcatcgctaaatcacaccccctctatcaagagttccgcctatggcaattcatagtcaacctccgcatataccgcaaagaaacggacgtcgacgtcacccaagaattactgccaaccgaagccgactacgttacgctattcgaatggctcaacgagaaaaaggaaatcgatcaaaaagcattcttcaaatacccgcctttcggcttcaagaaaaccaccagcaactaccggtggaactacgtggaagacaaaccatacccatgcaacgaaacccacgcccagatcatcacccgactcggaaaagcacacatacccaaagcattcctatccaaagagaaggaggaaacactgtggcacatcttgtacagcatagaggacaagcaagaaatcgagaaagccctacacagtttcgccaacaaaaacaacttgagcgaagagttcatagaacagttcaaaaactttccgccattcaaaaaggaatacgggtcgtactcagcaaaagcaatcaagaagctgctcccccttatgcgcatgggcaagtactggtcgatcaagaacatagacaacgggacgcgaattagaatcaacaagataatcgatggagaatacgacgaaaacatccgagagcgggttcgccaaaaggccataaacctaaccgacattacccacttcagggccctccccttatggttggcctgctacctggtctacgaccggcactcggaagtcaaggatatcgttaaatggaaaacacctaaagacatagacctatatctcaagagcttcaaacaacactccctgcgtaaccccattgttgagcaagtcatcacagagaccctgcgcacagtccgcgacatatggcagcaagtcggccatatcgatgagatacacatcgagttaggcagagaaatgaaaagtccagcggacaaacgagcacgcatgagccagcagatgattaagaacgaaaataccaacttgcgcataaaagcactcctaactgaatttttaaaccccgagttcggcatcgagaacgtgagaccctactctccaagccaacaggacctactgcgaatttacgaggagggggtactaaacagcatcctcgaactccctgaagacatcggcattattctcggcaaattcaaccagacagataccctgaaaagaccaacgcgatctgaaatcctccgatataaactctggctcgaacagaaatacagatcaccctacaccggggagatgataccactaagcaaactcttcaccccagcctacgaaatcgaacatattatcccacaatccaggtacttcgacgactctctctccaacaaggtcatctgcgagtcagaaatcaacaagttaaaagaccgatccctaggatatgagttcatcaaaaaccaccatggggaaaaagtagaactggcgttcgacaaaccagttgaagtactcagcgtcgaggcttacgaaaaacttgtacacgaaagctactcccacaaccgcagcaaaatgaagaagctactcatggaagatatccccgaccaattcatcgaacggcaactaaacgactcacgatacataagcaaagtcgtcaaatctctcctcagcaacatcgtgcgagaagagaatgaacaggaggccatctccaagaacgtcataccgtgcacaggaggaatcaccgaccgtctaaagaaagactggggcatcaacgacgtttggaacaaaatcgtccttccacgtttcatccgtctcaacgagctcacagagtccaccagatttacctccatcaacacgaacaacaccatgataccaagcatgccgctcgagctacaaaaaggttttaacaagaagagaatcgaccaccgacaccacgcaatggacgcaataatcatcgcatgcgcaaaccgcaacatcgtaaactacctaaacaacgtctccgcaagcaaaaataccaagataacccgcagggacctgcaaaccctgttatgccacaaagacaagacagacaacaacggaaactacaaatgggtcatcgacaagccgtgggagacatttacccaagacaccctcactgcgctccagaaaataaccgtgagcttcaaacaaaacctaagagtcataaacaaaacgacgaaccactatcaacactacgagaacgggaaaaagatagtgagcaaccaatccaagggagactcctgggctatacgcaagtcaatgcacaaggaaaccgtccatggagaggtaaacctccggatgataaaaacagtcagtctaaacgaggccctgaagaaaccccaagccatcgttgaaatggacctgaagaagaaaattctagcaatgctcgaacttggatacgacacaaaacggattaaaaactacttcgaagagaataaggatacctggcaggacataaacccttccaagatcaaagtctactacttcacgaaagagaccaaagaccgctacttcgccgtacgcaaacccatcgacaccagcttcgacaagaagaaaatcaaagagtcgattacagacacaggaatacagcagatcatgctacgacatcttgaaaccaaagacaacgacccaaccctcgcattctcccctgacgggatcgacgaaatgaaccgcaacatactgatcctcaataaaggcaaaaagcaccaaccgatctacaaggtacgcgtgtacgaaaaggcggaaaaattcactgtaggacaaaagggaaataagcgcacaaaattcgtcgaagccgcgaaagggacgaacctcttcttcgctatctacgaaaccgaagagatagacaaagacaccaagaaagtaatacgaaagcgcagttattccaccataccacttaacgtagttatagaacgtcaaaaacaagggctgtcgtccgcgcccgaggacgagaacgggaaccttcccaaatacatcctctcacccaacgaccttgtctatgtcccgactcaagaagaaataaacaaaggagaagtcgtgatgcccatcgaccgagaccgcatatacaagatggtcgactcaagcggaataactgccaacttcatccccgcatcgaccgcgaacctcatcttcgctctaccgaaggccaccgcagagatctactgcaacggcgaaaactgcattcagaacgaatacgggatcggcagcccccaatccaagaaccaaaaagcaataaccggggaaatggtcaaagagatatgcttccccataaaagtcgaccgcctaggcaacattattcaagtaggttcctgcatactgaccaactga

SEQ ID NO: 6919 - RNA, 4575 nt, synthetic construct
  misc_feature 1..4575: note = Cas9 variant
  source 1..4575: mol_type = other RNA
atgaacaagatcctaggcctcgacctcggcaccaacagcatcggctgggcgatagtgcaaaaggacgaacaaggtttttacgaaaagatcataaacgcaggctcccgaataataccaatggacgctgaaacaatgaacaacttcaacaaggggattaccaaaagcccagcgtccgaacgcaccagattccgcggagcccgaagactcatcgaaagatcgctcctacgaagggagcgcatccaccgactactaaacaccatgaattacttaccaccccactacgcagagaaaatcgactttgtcaaccgactcggcaagttcataggggaagaggaacccaagtacgcctacaaagtagacgaacatggaaaattccagttcatattcaaggaaagtttcaatgagatgctgaaagacttccaagacaagcaacccgagctagtactcaacaacaagaaagtgccctacgactggacaatttactacctcagaaagaaagccttgaatcgggcaatcagcaaggaagaactaggatggatcatactgcaattcaacaacaagcgcggatattaccaactgcgaggcgaagaggacgagacgttaacagagggccaaaagaaagagtatttcgcacttaaagtcatccgggtcgaggccgactcaagcagcgctggcaaaaagggagaggtctggtacaacgtacagctggagaacgggtggatataccgctgcaaaagcgaaatccccctagactgggagggaaaaatcaaagagttcatcgtcacgactgaagtcgatgaaaacgacaacgtgcttaaggacaaagaaggtaaggagaagagaaaactcaaaatcccggaggcaggagattggaccctcctgaagaagaagacggaaagcgacctcgacaagagcggaaaaaccgtcggagcatacatatacgacaccctgctgtctaaccctgaccagaaaataaaaggagggctaatcaggacaatcgaacgggaactataccgatccgagctagaacaaatactcgacaaacaaaaagagttccaccccgaacttaaagacgggaccctttataataaatgtgtggaggaactatacaggtcgaacgaatctcgaaggatcagtctatcgaactacgacttcacgcgcttcataacggaggacgtaatattttaccaacggcctctgaaatcgaagaaaagcctaatcgacaactgcagcttcgagcgccggaactatctcaacccgattacgaaggaattggcgtacgcacccataaagtgcatagccaaaagccaccccctcttccaagagttccgcctgtggcagttcataaagaacctcagaatcatagagcgggaaaagattgtaggggacaagctcatgttcgaccaggacgtcaccacagagttcctgccgacgcagaacgactacgtcatcctatttgactggctgaacgaacacaaagagatcgaccaaaaggccctgctaaaatatcctgcgttcaacctcaagaaaaacatagacaagtaccgctggaactacgtcgaaaacaaatcctacccgtgcaacgaaacacgagccctgctaaaggccaaactcaacaaggcaggtaatatcccctccgacttcctagacaatgatactctcgagtccctgtggcatatactatattcagtcgaggacaaattcgaaatagaaaaagcactaaagagcttcgcgaccaagaaagagctacgggaggaacaaacggtagcattcgtcaaacaattcataaacatcccacctttcaagaaagaatacgggtcctattcagcgaaagcaatcaaaaagctattacaactcatgagaatgggtagcagatggtcagaaaacgagatcagtgactcgacaaaagaccgaatacagaagctaatcgacggagaatgggacgagagcataaaaacccgaacgcgggacaaagcaataaaactaaacgagatcaatgactttcagggactcccactatggcttgcatcctacatagtctacgacagacacagcgaatccggcgatgtaatgaaatgggaaacaccggaagacatagactactacctcaaacacgtgttcaaacaacacggcctacgaaaccccatcgtagaagtggtagtcgtcgagacgctaaaggttgtaaaggacctctggaaaacatacggctacttcaacgaaatacacatagaactcggacgggagatgaagaatccggccgacaaaagaagatcgatgacaaacaaaaacatagagaacgaaaacacaaacctacgaataaaggcgctactcgcggagctggcgaaccacaaggatgtggagggcgtacgcccctatagtccaagccaacaagagatcctcaagatctacgaagaaggcgtcctagacatgctaaccaaagaagacccggactacgaaagtatctcgaaaatcagcaaaatggccctccccagctcctcagaactgataagatacaaatgctggctcgaacaaaaatatagaagcccctacaccggccaagtaatcccgctggcgagactattcacgagcgaatacgagattgaacatataatcccgcaaagccgctacttcgacgatagcttttccaataaagtgatttgcgaaagcgccgtcaacaaagataaagataacctgctggcctacgaatacatcaaacaaaacgagggcaagatcatcgaaataggcctgggaaagaaagtaaaactcttcaccgcggatagctacacagagttcgtccaaagcaactacgtcggatccgtagcgaaaaagaagaaattactgatggacacaatacccgacagtttcatcaaacgccaacttaacgacagccgctacatctcccgcgagataatgaaacttctgagtagcgtcgtgagagagaaagaagaagaagaggaagaagaagaagaggaggcaatctccaaaaacgtcatcgtttgcacaggggccattacagacaaacttaaacgtgagtggggcctaaatgatgtctggaacaccatcatttacccacgattcgagcgactaaaccaactaaccaacagcgataaattcggccaatgggaaaacaaacagggtaagaaagtcttccaaatcgagatgccgctgaaacttcagaaaggcttcaacaagaaacgcatcgaccaccgccatcacgcgatggacgctatcgtcatcgcgtgtgcaacacaaagccacgtaaattatctcaacaacgaaagtgcacactccaacagcaaagagaaaagatactacctaagacgaaaactgcgccgcatcgaaatattagagaaacaggaactcaaggacggcgtcacgatcacaaagaagattgaagtagcgaaggagttcaacaaaccatggccaacgttcacccaagacgctcacgaagtactacagagcataatcgtcagctttaaacaaaacctcagagtagtaaacaaagcgacaaaccgctacgcgtgcttcgtaaacggaaagaaagagatagtcaaacaaagcaaaggggaatcctgggcaatacgaaaaccgatgcataaagacaccgtatccgccgcggtgagcctaagaaagatcaagacggtctccctcagccaggcgatagacgactggacaaacatcgttgacaaaagcctacggaaggagatcggcctcctatacagcaaatacggccagaatggcagcaagaatatcatcaaatacttcaaagacagagacaacaagcacaacggactagacgtatcaaaagtaaacgtccattacttcgacaatgactacgcggcaagccgcgtcgcgctagaccataagttcaacagcgctaaaataaagtcaatcacagacacaggaatccagacgatactactcaaacacttggagtcctacaacgaaataaatggcgacaagataatagagcaccccgagctagcattctccgccgacggactcgacatcctcaacgccaacataacgaaactcaacaacgggaagttccacaaacccatcaagaaagtccggaaaaccgagaccctcggtctcaaattcatcgttggacagacggggaataagcgaaagaaatacgtagaggcagccgacggaaccaacctgttcttcgcaatctatgtatcagtagatggcattagatcgtacaaaaccataccactacgagaagtagcagaacgcctaaaggagggcctgatccccgtacccgagaagaatgataaagacgaccatctgctattttggctgtcgccaggcgacctagtctacgtcccgagcattgaagaggaaggccgcatagtcgaaatcgaaaacatcaaacaggaccgcatatacaaagtcgtaagctgcacagagaacgaatgccactgcataccgcactttgtggcaagtcccatcgtaaagacagacgaattgggagctaacaacaaggcccaaagggcatggagcggggaaatgataaaggaaacttgcataaaaataaagatgaaccgactcgggcagatagtcaagatatga

SEQ ID NO: 6920 - RNA, 4581 nt, synthetic construct
  misc_feature 1..4581: note = Cas9 variant
  source 1..4581: mol_type = other RNA
atgaagaaaatcctaggactcgacctaggcaccaactcgatcggatgggccgtcctcaacgcagcagacgacaattcactgaaatacatagaggcagcgggctcccgcatcatacccatggacgccgcaatcttaggcgacttcgatcgaggcaactcgatctcccaaacggccgagcgaacgcgtatcagaggaatgcggcatctccgcgagaggtatctcctccgccgggcgcggctacaccgcatcctgaacctattggggttcctgcctttccattacgcacaagacatagaccgctacggcaatttcagcgccgacatggaacccaagatcgcctggcgcaaaaacctggaaggagagctggagttcattttcatcgaatccttcaacgaaatgctcgaggacttccgaaagaatcaacccgaactcgtcgcagacaacaaaaaggtgccttacgactgggtcatctactacctaagaaagaaagccctcgagaagaaaatcagcaaagaggaactcgcatggatcctcttaaatttcaaccagaaaagagggtactaccaactacgaggagaagacgacgacgagtcgatgaaaactgccaaaaccagacaatacttcgacaaacaaattatcaaaaacatcatcgacacgaaccaaacttacaaaggccaaaggatcctcatcgtcgaactgcaaaacggagacaagggcaagatattcaagaaagaaatcccggactggataggccaagagaaaaacataatagtaaccgtcgatatagataaagacggcaacgacaaatacgaagagagcggatcccttagctgccgcttcaaaatcccgactgacgcggaatgggaatcagaatggaagctcatcaaaatgaagacgcaaaaggacctagatgaatccaacaagacggtcgggacctacatctacgacagcatactacagaaccccacccagaaagtgcgcggcaaacttgtccgcacaatcgaacggaagtactacaaggcagaactaaagcaaatcctagaaaaacaaacggagttccatagtgaactgcaggataaggatctctatatagagtgcctgaacgagctgtacagcaacaacgacacccatcgaaacgccatcaccgacagagacttcgtctacctgttcatgaacgacatactcttctaccagcgaccgctaaagagcaagaaatcactgatagacaactgcccgtacgaacgcaacatctacatcgacaaagaaacgggggagatcaaatacagcccgataaaatgtatcgccaaatcgcaccccctgttccaagagttccgcctttggaagttcatctccagcatccgaatctaccaacgagaaagcgttgtagaagtggtcgacaaacaactcgatctgtttagctcgcagagcacctcagtacagaaactcgtcacggacgtagacgtcaccgacaaattcctaacttgcgaaaacgactacgtcgccctattcgaatggctaaacaaaaagaagatcatcgatcaaaaggagttcttgaaatatcgccccttcggccttaaaggagacattgataactaccgatggaactacgtcgaagacaaaagctacccctgcaacgaaacacacgcaatgatcctaacgtacttcgcaaaggccggaataagcgaagatatcctcaccaaagaaatggaagaggccctatggcacatcttatacagcgtagaagaccgacaggaaataactaaagccctacgaaccttcgccagcaaataccaccttagcgattcgttcgttaaagtattttcaaacatacccccatttaagaaagaatacggctcctacagcgctaaagccatcaaaaagttgttatccctcatgagaatgggcaagtactggtccgaggacgccatagacgtaaatacacgcgaacggatagacaaaatagtaacaggagaatatgacgagaagataagagaccgcgtccgcgagaaaaccatccgcctaaacgacatcagacacttccgggccctgcccgactggttagcatgctacgtcgtctacgaccgccacagcgaaacccgcgaaatcaccgaatggaaatcccctgaagaaatcgacgaatacatacgaaacttcaagcagcactcattacgcaaccccatcgtcgaacaggtgatcacagagaccctaaggacagtacgagatatctggaaacaagtcggctgcatagacgagatccacgtcgaactaggcagagagatgaaaaacccagctgacaaacgcaagcgcatcacgtcacaaatcatcgagaacgaaaacgcaaatcttagagtgaaagcactcctaacggagttcgtcaaccccgagttcgaaatcgaaaacgtcaggccctacagcctcggacagcaagacatacttcgcatttacgaagatggtgttctaaactccgtagcggaagtgccgggagacatcgccgggattctcaagaaattcaacgaaaacgacgccaagaaacgcccaactacatcggaaatactcaggtacaaactctggctcgaacaaaaatatcgatcgccttataccggagaaatgatacccctgtccaaactattcacatcagcctacgaaatagagcatgtcataccgcaaagccgctactttgacgactcattctcgaacaaagttatatgcgaagctgaggttaacaaactcaaggacaatgcgcttggctacgagttcatcaagaaacaccacggggaaaaagtcgaactcggctttgggaaaatagtggaaatattcagtgtatcagtctatgaacaattcgtgaaagacaactactcgcggaacagaggcaaaatgaaaaagctcttaatggacgaaatacccgaacaattcatcgagcgacaactcaacgacagccgctacatttccaaagtcgtaaaaaccctgctgtcgaacgtagtacgcgaaaaggcggaacaagaagcggtgtcgaagaacgtaatcgtgtgcacaggcggcgtaaccgaccggctcaagaaagactggggcataaacgacgtttggaacaaaatagtactcccccgattcctccgcctcaacgaactgaccaactccaccaacttcacagccaaaaacgccgccggcaacgaaatacccgccatgccacttgaactgcagaaagggttcaacaaaaagaggatagaccatcggcaccacgcaatggacgcaattgtcatcgcctgcgccaaccgaaacatcgtgaattacctgaacaacgagagcgccagccgaaaagcgaagatcagccgccacgaccttcaggcgattctgtgcgacaaagttcgaacggacgacaaaggcaattaccagtggcgcgtgaagaagccatgggataccttcacacaagacgtctacgtcgccctcgaaaacataattgtaagtttcaaacaaaaccttcgcgttataaataaaacctccaactactactggcattacgaaaacggtaaaaaggtgctggttaaacaagtcaagggagactcctgggcaatacgcaaacccatgcacaaggacacggtatttggagaagtaaacttgcgcaaagtaaaatccgtcagtctaaacgaagccctcaaaaacccccaattcatcgtagaaaaagacctaaaacgacaactcctctccctactccaacaaaactttgatataaagaaaatcaaaaagtacttcgaggagcacaaagacatatggtcagacatcagcctcagtaaaatgaatatctactacttcaccaaggaaacaaaagaccgatacttcgccaccagaaaaccactcgacgcatcattcgacaagaagaaaatagaaagctgcataacagacaccggcatccagcaaattctactccgacacctcgaactaaaagaaaacgatcccgagcgcgctttcagcccagacggtatagacgaaatgaaccgaaacatcatacaactaaataaagggaaaggccaccacccaatcgcgaaggtacgcgtctacgaaaaagcggacaaattcgaagtaggccagcgcggcaacaaatcttccaagttcgtcgaagcggccaaggggactaatctatttttcgccgtatacgaaacagaataccccgacgagaaaaccaactcgatcgtccgaaaaaggaactacgccaccataccgctaaacatcgcgatcgaaagacagaaaagaggtctctcgaccgcgcccgaagacgagaaaggcaacgtccccagcttcgtactctcaccaaacgacctcgtctacctaccgacctccgaagacatcgtgaacgggcacataacacaacccatagacaaaagcagaatctacaaaatggtttcatcaagcgggtcccaatgcttctttataaaacacaatatcgcaaatatcattgtagacaaatacgagttctccccgcttaacaagatggaaagagcaatatccaacgagatgataaaagagatctgcatacccgtaaaagtcgatcgcctgggaaatatagtaaaactggggaagtctgagtga

SEQ ID NO: 6921 - RNA, 4581 nt, synthetic construct
  misc_feature 1..4581: note = Cas9 variant
  source 1..4581: mol_type = other RNA
atgaagaagatcctcggcctagatctgggaacaaacagcattgggtgggccgtactaaacgccgcggacgacaactcactcaagtacatcgaggcagcaggcagccgaatcatacccatggatgccgccatactcggggatttcgatcggggcaatagcatatcacaaaccgccgagagaacacgaatacgaggcatgcgccacctcagggaacggtacctattgaggcgcgcccgcctacaccgaatcctaaacctactcggcttcttgccgttccactatgcacaagacatagaccggtatggaaacttcagcgccgacatggaacccaaaatcgcctggtgcaaaaatctcgagggcgaactcgagttcatcttcattgagtcattcaacgaaatgctcgaggactttcggaaaaaccaacccgaactggtcgccgacaacaaaaaggtcccttacgactgggtcatctactacctaaggaagaaagccctagaaaagaaaatcagcaaagaggaactcgcctggatactactgaatttcaaccaaaaacgaggatattaccaactccgcggcgaggacgacgacgaatcgatgaaaaccgccaaaacacgacaatactttgacaagcaaataatcaaaaacataatcgacacgaaccagacctacaagggacaacgaatccttatcgttgagcttcaaaacggagacaaaggcaaaatctttaagaaggaaatcccagactggataggacaagaaaagaacatcatcgtcaccgtagacatcgacaaagacgggaacgacaaatacgaggagtctggctccctcagctgccgcttcaagatcccaacagacgcagagtgggaatcagaatggaaacttataaaaatgaagacccaaaaggacttagacgaatcaaacaaaaccgtcggcacctacatatacgactcgattctccagaacccaacccagaaagtgcgcggtaagctggtgcgaactatagagagaaaatactacaaagcagagcttaaacagatactcgagaagcaaacggagttccactcagaactacaggacaaagacctttacatcgaatgtctcaacgaactctactccaataacgacacccaccggaacgcaatcacagaccgcgacttcgtttatctcttcatgaacgacatactgttctaccaacgccccctcaaatcaaagaaatcgctgatcgacaactgcccgtacgaacgcaatatctacatagacaaagaaacgggcgaaataaaatatttaccgatcaaatgcatagcgaaatcacacccactctttcaagagttcagactctggaaatttatctcctcaatccgaatatatcaaagggaaagcgtcgttgaggtagtagacaaacaactcgacctcttctcctcacaaagtaccagcgtccaaaagctcgtaacagacgtcgacgtaaccgacaagttccttacctgcgaaaacgactacgtagccctattcgaatggctaaacaagaaaaagatcatcgaccagaaagagttcctcaagtacagacccttcgggctaaaaggcgacatagacaactacagatggaactatgtggaggacaaatcgtacccatgcaacgagacccatgccatgatcctaacctacttcgctaaggcaggaatctcagaggacatactaaccaaagaaatggaggaggccctttggcacatactgtacagtgtagaggaccgtcaagaaataactaaggcactcaggactttcgcaagcaaatatcacttatccgactcgttcgtcaaggtattttcgaacattccaccgttcaagaaagaatacgggagctactccgcaaaagccatcaagaagctgctgagcctgatgagaatgggaaaatactggtccgaggatgccatcgacgtcaacacaagagaaaggatcgacaaaatagtcaccggcgagtacgacgagaaaatccgggaccgagtacgggagaaaaccattcgactcaacgacatccgccacttcagagctctgcccgactggctagcttgctacgtcgtatacgacaggcacagcgaaacgagagagataacggaatggaagtcccccgaagagatcgacgagtacatacggaacttcaaacaacattcgctccggaaccccatcgtagagcaggtaataactgaaaccctgcgcacagtcagagatatatggaaacaagtggggtgtatagacgagatacacgtggagctagggcgggaaatgaaaaaccccgcggataaaaggaaacgcatcacctctcaaatcatagaaaatgaaaacgccaacctacgagtcaaggcgctactaaccgagttcgtcaacccagagttcgaaatagaaaatgtccgaccctactcactatcccaacaagacatactccgcatctacgaagacggcgtgctgaacagcgtagccgaagtcccaggagacattgccggaatcctgaaaaagtttaacgaaaacgacgctaagaaacgccctacaacaagcgaaatcctacgatacaaactatggctagaacaaaaatacagatccccatacacgggcgaaatgataccgctctccaaactgttcaccagtgcgtacgagatagaacatgtaatcccccaatcaagatacttcgacgactcattcagtaacaaggtaatatgcgaggcagaagtcaacaagctaaaagacaacgcgctaggctacgagttcataaagaaacatcacggagaaaaagtcgaactcggtttcgggaaaatagtcgaaatcttttccgtatcggtatacgaacaattcgtcaaagacaactactcaaggaacagaggcaaaatgaagaaactcctaatggacgaaattcccgagcaattcatagagcgccaactcaacgactctcgctacatcagtaaagtcgtcaagacgctcctaagcaacgtcgtgcgcgaaaaagcagagcaggaagcagtgtcaaagaacgtcatagtatgcacgggcggagttaccgaccgactcaaaaaggactggggcatcaacgacgtctggaataagatagtactaccccgcttcctgcgcctcaacgagctcaccaactctacaaactttaccgctaaaaacgcagcggggaacgagatacctgcaatgccattagaactgcaaaaaggattcaacaagaaacgaatagaccaccgacaccacgcgatggatgcaatcgttatcgcgtgcgccaacagaaacatagtgaactacctcaacaacgaaagcgcaagccgaaaagcgaaaataagccgccacgacctccaggcgatactgtgtgacaaagtcaggacagatgacaaaggcaattaccaatggagggtaaagaaaccgtgggacactttcacacaggacgtgtacgtagcactagaaaacatcatcgtcagtttcaaacaaaacctgcgagtgataaacaaaactagcaactactactggcactatgagaacggaaagaaagtcctggtcaagcaggtaaagggcgactcgtgggcaatcagaaagcccatgcacaaggacacagtcttcggcgaagtgaatctacgtaaagtgaagagtgtgtctctaaacgaagccctcaagaacccccagttcatagtagaaaaagacctgaaacgccaattgctaagcctcctccaacagaatttcgatataaagaaaatcaagaaatacttcgaagaacacaaagacatatggtcggacatatccctctccaagatgaacatctactacttcacgaaggaaacaaaagaccgatacttcgccacacgcaaaccgctagacgccagcttcgacaaaaagaaaatcgaaagctgcatcacagacacagggatccaacaaatactgctgcgccatctcgagctcaaggaaaacgatccagagcgcgccttctcgcccgacggcatcgacgaaatgaatcgcaacatcattcagctcaacaagggaaagggccatcaccccatcgccaaagtacgagtatacgagaaagcggacaaattcgaggtcgggcagcgcggtaacaaaagcagtaaattcgtagaagccgcaaaaggcaccaacctattcttcgcagtatacgagaccgaataccccgacgagaagaccaactcgatcgtgcgaaaacggaactacgccaccatccccctcaatatcgcaatagagcgtcagaagcgaggactctcaactgcgccagaagacgaaaagggcaacgtccccagcttcgtcctatcccccaacgacctcgtctacctcccaacctcagaagacatcgtaaacgggcacataacacaacccatagacaaaagtcggatctacaagatggtatcgtccagtggctcacagtgcttcttcatcaagcacaacatagccaacatcatagtcgacaagtacgagttcagcccactgaataaaatggagcgcgcaatatcaaacgagatgatcaaggaaatctgcatcccggtcaaggtcgatcgcctgggcaacatcgtaaagctcggcaaaagcgaatga

SEQ ID NO: 6922 - RNA, 4584 nt, synthetic construct
  misc_feature 1..4584: note = Cas9 variant
  source 1..4584: mol_type = other RNA
atggccaagatcctaggactcgacctggggacaaacagtataggctgggccatagtagagaaagatgggaatgacttctcgctagtagacaaaggcgtgcgcatattctcagagggcgtaaagtccgaaaaaggcatcgagagctcaagggcagcagagagaaccggctaccgtagcgcaagaaagatcaagtatcgccgcaaactccgaaagtacgagacgctgaaggtgctatcactcaacgggatgtgccccctatcaatcgaagaggtagaggagtggaaaaagtccggcttcaaagaatatccactcaaccctgaatttttagaatggctaagaacatcggacgacgaaaacatcaacccctatttcttccgagataaggcatccaaacagaaggtcaccctctttgaagtcggccgcgcgttttaccacatcgcccagaggcgagggttcctgtcgaaccgactggaccaaagtgcggaaggcatactagaagaacattgccccaagatcgaagccctagtagaagacctgaactcaaccgacgagatactaacctccctaaaggactacttcttcgacacaggcattctggacgccaacgaaaaaggaggcttcgccaaagacctcgacgagggcgacaagaaactggtgtcgctctaccgatccatccaagcaatcgtgaagaaaaacgacaccgacttcgaaaagggaaaggccgaaatcatcgagcgtctgaacaagaaagacgtactgggaaaggtcaagggaaagatcaaagatatatcacaggccatgctagagggtaacttcaaaaccctcggtcaatatttcttcagcctctataacaaagaacgcattcgaaaccagtacacgtcaagggaggaccactacctagaagagttcaaaatcatatgcaaattccaaggaatcggaagcatcaatcaaaacgagaaactgcccgagaaaaagtttgaagggctagcgaaagaactgtacaaggccattttcttccaacggccgctcaaatcccaaaaaggacttatcggaaaatgcagcttcgagaaatctaagagccggtgcgcgatatcgcaccccgacttcgaggagaagcgcatgtgggaatacctgaataccattaagataggcacacagtccgaaaaagttctgcgcttcctatcacaagaggagaagctcaacctcatacctaaattcctgaggaagaaagacaacttcaacttcgaagacctcgccaaagaactaatagaaaaaggggccacatttggattctacaaatccagcaaacgtgactccttccactactggttcaactacaaacccacggatacggtcagcggctgcccggtcagcgcctcactaaaatcagttgtgggggaagactggaaaaccaaatcgttcatttacaaaacaacaaactccaagggaattgaggtatcacgaacagtgaactacaaggacctgtggcatctgctaagcgtctccacctctgacatatacttatatgagtacgccaagaacaagctcggactggaagataaaaacgccaaagcgttctcaaagataaagctaaagaaagattttggaaacctctccctcaacgcgatcaacaaaatcctcccgtacatgcgagaggggttactatactcacacgccgtattcatggcgaacatagaatccatcgtagatgaggtcatctggaacgacctagggcaacgaaagtacatccaagataagatcgcagccatcatagcaaacaacatcgtagataatggactcctggaagtcgtcaacggactcatcaaagagtgtaaagtagatggcgcatactacagcaaagaggccgccgacacatacaggaaggacctctccaagaagctcgtatccttcttcaaattccaccacatcgacgacggcataaagcaagagacaatcctcaacgaactcttcccagtcttcattgagcaactcaaggcccacgagttcatcaaagtaaagcggctcgacgaaaaagtgctcgagttcctgaaaggggaaaatcaagatggagaagtattctgcaacaacgcaaaacaactaaagaaactgtaccatccatccgacatcgaagttttcaagaaacagatcgtcaaagacaaagatgggaccgaaacgggccagctcatactgggcagcccgctaaccagctccatcaaaaaccccatggcaatgcgagcccttcatcaactccgaaaagtcctcaacacccttatcgtagaggaacaggtcgattcaagtacccggatacacattgaaatggcccgcgaactaaacgatgcgaacaaacggaaaggcatccaggactaccaaaacgaaaacaagaaagaacgcgagaaatacagggacgaaatcaagaaactctacctcgcggaatgcaataaagaaattgaacccacagtagacgacctgctaaggtaccagctctggatcgagcaagaccgaaaagaaatctacgagaacgggaactccatctccatatgcgatatcataggcgacaaccctgcgtacgacatagagcacactgtaccgcgaagcatctcccaagacaattcccaaatgaacaaaaccctctgcagccaaaaattcaacagggacgtgaagaaacagaaaatgccctttgagctgggcaaccatctggagatcttgccaaggatagcccattggaaagaagaagccgacaacctatcccgagagatcgagatgatcatacgctcaaccaaaacagccgctacaaaagaggcaaaagacaagaaaatacgccggcgacactacctcacgctgcggcgagactacttgcaaggcaaatacgaccgcttcatctggaccgagccaaaagttggcttcaagaactcgcaaatccccgacaccggcattataacccggtacgcccaagcatacttaaaaagctacttcaaccgagtggagtcagtcaaagggggaatggtggcggagttccggaaaatatggggtatacaagaaagctatcaagagaacgggaaaaagtacttcaaagagaaagatcgatcgaaacacacgcaccacacgatagacgcaatcaccatagcatgcatgacgaaagacaaatatgacgtcctcgcccacgcatggaccctagaggacaaagagcaaatcaccgaagcccggaaaatcgtcgccgagtccaaaccctggaaaaccttcaaagaggacctaaagaaaatcgaggaaggcatcctcgtatcccactataccccagacaacgtgaagaaacaatcaaagaaaatcgtccgcgttcgtggccggaaacagtacgtcgccgagatcgagcgcgacgtaaacggaaaagctgtggcaaagaaggacatcagcggtaaagtgatctacaaacttgacaaggacggcaagaaactaccgcggctacaacaaggcgacacaatccggggaagtcttcaccaggacagcatctatggcgcgatcaagaacccactcaaaaccgaggagatacgatacgtcatccgcaaagacttggaatccataaaagctagtgacgtcgacaacatagtcgacgaaatggtaaaagaaaaagtgaaagaagcaatagcctccaaagtccttatcctctcgtctaatccccagcagaaaaataagatcgacggcaaagtctggatgaacgaggaaaaagggatcccaataaacaaggtccgcctttacgcgaacagcgtcaaaaaccccctcgagataaaggaacatagctcactcagcaaatcacgccacgaacacaaacaaaaagtatacggacagaacgacgagaacttcgccatggcaatctacgaagggcttgacaagaagggaaagacggaacgagcattcgagctcataaactacatggatgccggttactactacaagctaaagaacaaaaatgagaggaaaaaggacatcatatccttagtccctgaaaaacacatcgaaaccgggttcaatctactgcggtcgaacaaaatcccaataatcctgaagaaaggcctcaacgtcatcctatataaaaatgaaaaagaagagatcgattttaacaacccaaattcgatcatcaaaagactatataagataagcgggctagacaaagatggaatcaaactaatgtactgcatcagcgccaagggatcaaccgaaaacatcgcgtacatgaatgacgtcatcaacaagcagaagctattcgaactaaaatcagaaatggagaaactggggctatgggacaaagtattcagcgactttaagaacgacaacctgaaaaagtccgactttttcaagaaattaaacgacctacttaacaagcactactttgagaacaacgtctgcgacagcatcggaagtatcaagaaggtcaaaatcaaggagagtggcctaacgacccctaaaggcggtgacgtgatagacaacttcaaagacttcccatacatcaagttcaaagtaagcaactttaatgcactcatagaaggaattgacttcaaaatttccccaaccggcaagttcgtacaaatctga

SEQ ID NO: 6923 - RNA, 4587 nt, synthetic construct
  misc_feature 1..4587: note = Cas9 variant
  source 1..4587: mol_type = other RNA
atgaaaaagatcctaggactagacctcggaacgaatagcataggatgggccctggtggagcaggacttcaaaaacaagcaagggaatatcatgggaatgggttcacgcgtaatccccatgtcccaagagattctcggagaatttgcacggggcaatacgaaaagcgagacagcggagcgtacccgcctacggagcgtgagacgactacgggagcgccacctcttaagacgcgaacggctacatcgcgtactccacatactaggcttcctacccaagcactacgtaaaccaaatcgacttccaggaacgactaggaaaattcttcgaagaaagcgaaccgaaactagcatacgataccggggactttctctttaaaccatctttcctagagatgcttgaagagtttaagatacaccaaccctcgttcgtcgaaggcgataaaaaggtaccctacgactggaccatatactttctacgcaagaaagccctaacagagcggatcgaaaaagaagaactcgcctgggtaatcctgagttttaaccagaaacgtggatattaccaactacgaggcgaggatgaagaagaaaagcccaataaacttgaagaattttactcgctaaagatcgtcgacataaaagtcgacgagtcaccgaacaagaaaggggacacctggtactcactcaccctcgaaaacggctggatctaccggcggtcctctaaagtccccctggatgattggctcgggaaaacaagggactttatcgtcacgacagacatagatgaagaaggcaacccgaagctggacaaagagggaaacccgaagcgatcttttcgagccccatcggaagacgactggggcctgaggaaaaagaaaacagaaaaagaaatccttgacagcagcaaaaccgtcggacacttcatattcgagaatctgctagccgaccccacccagaaaatcaaaggacggctcgtacgaaccatagaaagaaaattttataaggacgagctaaaacaaatacttgtatcgcaaaaccgcttccatccagaactatccgacgccgatatgatggctgattgcgtgcgcgagttatacaaacacaaccattctcaccaaaacttcctcgcaagcaaagacatcaaacacctcctcgtcgacgacatcatattctaccaaagacctctccgaagccagaaaagcacaatcggcaattgcccccttgagttcaaaacttttaagaaagacggaatcgaaatcaaagtcccctataaggtcgcgccaaaaagccaccctctcttccaagagttccgcctccttcagtgggtctccagcttaagaatcatccggaagtctgacgactcagacgtaacccgcgaatttctcgggacccaagacaagaccaagcaactgctggactacctgatgacccagagcgaaatggactgcaacaaactcatgactttcctacttacacaagaaggatacaagagaaaggacctaaaaagcgaagttggcaaattccggtggaactacgtattcgactccgaaacgggcgaatcaaaaacttacccaggaaacagcacgcgagccgagttcctcaaaagattgggaaaggtcgaagggttcgacttcagcaaatacaccgaagaatttgaggaatcactatggcacctggtctactcggtcactgataaagtagaatttgagaaggcgctgcgcaaattctcaaggaaaaatgggatagaaatcaactccttcgtagaaaacctgaagaaatttcccccatacaaaagcgaatacgccagctattccctaaaagcaatcaaaaagctattagccctcatgagatttggcgaaaactggaaggaagattcgatagacagcatcagcaaacacagaatcgagaagattctcaccggcgaatatgatccggaaataaaggataaggtccgggagatctcaagggcgttcgacgaagtagaggacttccaaggccttccagtgtggttcgcgaactacgtagtatacggcagacactctgaagcatccgaattaatcaaatggacaagctccgacgaaatggccgacttcatcaaggagttcaaacaacacagcctccggaaccccatcgtcgaacaagtcgtactggaaacccttagggttgtaaaagacatctgggacaaatacggacacggtcagaaagacttcttcgatgaaatccacgtagaactaggacgtgaactcaaaaaccccgcagaacagcgagcccgcctaacaacacaaatatctgcaaacgagaacaccaacctacgcatcaagtccctcctcgtagaactactccacgacccaggcgtcgaaaacgtccgtccctactccccaatgcaacaagagatcctgaaaatatacgaagaaggagtcttaaaaagcagtttcgaagtacccgacgacatattaaagatatccaaaacagcccagccatcctcaagcgatctaaagagatacaagctatggctcgagcaaaagtaccgatctccctacaccggaaagatcataccgctcaacaaactcttcacccccgcatacgaagttgaacacgtaattccccagtcacgctacttcgacgacagcttcagcaacaaagtcatctgcgaagctgcagttaacaaactaaaagacaaccgactgggaatggagttcatcaaatgcttccacggccaacgagtgtcactcggcttcggggaagaagtcgaaatcttcagcgagtctgcatataaggctttcatccaggacaacttcccaaagaaccccgcaaagaaaaggaagctcctgatggacgagctacccgagcaaatggtggaacggcaaatgaacgatacacgctacatatctaaattcgtaacttccatactctccaatatcgtccgcagcgaggaaaatgacacgggcttcaactcgaaaaacataatccccggaaacggcaaaatcacaaccgccctgaaacaagactggggactaaacgatgtctggaatgaactaatcctcccgaggttcgaaaggatgaaccaactaaccggcacaaccgtattcaccgcctggaacgaaaatcatcaaaaattcctaccgactgtacccctcgaatacgcgaaagggttccaaaagaagcgaatcgaccatagacaccacgcaatggacgcactggtgatcgcgtgcgcaacgcgagatcacgtcaactacttaaacaacgaacacgcgctcggcaagaactacaagggcaaggaagaaaaacaaagccgcaggtttgacctacgccaaaagctctgcctcaaaaagaaaaacggccactcacaggagcaatatgaatggatattttccaaaccatgggacagtttcactcaagacgccaaaaagaacctagagagaatcatcgtgagcttcaaacaaaatctgcgggtcatcaacaaaacaagcaacaaatacctcagctacaaggatgaggagggaaaccttagactggactcccaggggaagccagtcaaagcacttaccaggcaaatcaagggcgacgcctgggctattagaaaatcgatacataaagacaccgtcagcggccttgtgaaactcagacgcgtcaaaatggtaaacctatcggtcgctctggacaacccggaaaacatcctaaacaagaaactaaagaagaaaatcgcagaactcgtaaaactgaactatgacaacaaactcctactaaaatacttccgcgaccgcgactacatgttcgacggacgcgaggtctccaaattggacgtctactacttcgaggagggacttgcagcaagcagggtcagtctagacaccagcttcagcgacaagaaaatccaatccatcaccgacaccgggataagaaaaatcctacttgcacacctcgccaactaccacggccgcctagacgaaaaaggtaaagtcataccacccgagacactggccttcacacccgaaggaatagaagaactcaacaagaacataaaaggcctaaacggcggcaaattccaccagcccatattcaaggtgcggacctatgaaccgaagggcaacaaattccaggtgggcttcaaaggcaataaaaactcaaaatacgtcgaagctgcaaagggcacaaacctatttttcgcaatctacctcaatgatgaaggtaaacgaagctacgaaacaataccgttcaacgttgtgatggagcgcctaaaacaaggcgaaggaccagtcccccagaccaatgagaagggcgggaaactcctcttccacctatcacccaacgagctcgtctacgtcccagaaaccgacgaaaactacaccaacgtcgactttaagaacctctctaaggaacaggttgaaaagatatacaaaatggtatcgagcacaggatccgaatgtcatttcgtccgcgcggacataagctcactaatcaaaggctatgacgcaaaaaccaaagtgggggaactcggctcactcaacaaacaagaggttacaaataacggcatgacacgcattaaagaaaagtgctggaaaattaaaattgaccgactagggtctatctga

SEQ ID NO: 6924 - RNA, 4587 nt, synthetic construct
  misc_feature 1..4587: note = Cas9 variant
  source 1..4587: mol_type = other RNA
atgaaaaagatcctaggcatagacctcggaactaactctattggttgggccgtagtcaactcgtttgacgaaaaccagaacgaggaatctctaaaacacatagaatgcgtgggctccagaatcatcccaatggacgcggccatcctaggagatttcgacaaaggcaactctatctcccagacagccaaacggactgagttccgcagcgtaagacatctgcgggaacgtcacctcctccgcagggcgaggttacacaaaatcctcagcctgctcgggttcctccccgaccactacgttcaagacctagacagccacggcaacttccccgtcaatgtcgaaccaaagatcgcctggcgtaaagactccaacggcgcattcgagttcatcttcaatgactcctttgacgaaatgctgcaagacttcgcaacctaccaaccagagctcatagcatgtaacaaaaaggtaccatacgactggacaatatactacctacgaaagaaagcgctaaccaaaaagctctccaaagaagaactgtcatggattctactaaacttcaaccaaaaacgcggctattaccaactccgaggagaggaagatgacgaatcagtcaagagcgccaaaacacgacagtactttgaccggcagaaaattaagtccatagtggacacgaaccaaacatacaagggccaaaaggtactgatcgtcgaactagaggacggcatcaaaggcaaaatttttaaaaaggagatccccaattgggtaggtcaggagaaaagcatcatcgtcacaatagacatcgacaaagatggatgcgacaagtacgaagaatcaggggaactctcgtgccggttcaagatcccgtccgacgcagaatgggagtcagaatggaagctaatcaaaatgaagacccagaaggacctggatgcctctggaaagacagttggtgcgtatatatacgatgctatcctccaaaacccaagccagaaaatccgcggcaagctagtgaggaccatcgagagaaaatactacaaagaagagttaaaacagatcctcaagaaacaagttgagttccacccagaactaagagacaaagacctcttcctcgattgcctcaacgaactctaccccaacaacgacgcccaccgcaacgcctgcgccgaccgcgacttcatatatctattcatggacgatattctcttctaccaacgcccgctcaaaagcaagaaaagccttatagcagactgcccgtacgaaaaacacatgtacagagacaaagaaaccggagaattaaaatatagttcagttaaatgcatcgcgaaatctcacccactatttcaagagttcagactctggcacttcatatccaacataagaatctatcaaaaggaacgagtcgtcgacgtagacgcagaccaatccgccctttcgagcgcccgaagcgccctcaagtcgaaattagaagccgacgtggacgtcaccaatgagttcctcacatgcgaggcagattacgtcagcctgttcgagtggctcaataataagaaaagcgtgtcccaaaaagactttctaaaataccccgccttcggcataaagaaaagcggagacaactaccgctggaactacgtcgaagacaaaagctacccatgcaacgagacccgagccttaatcctcagccacctcgaaaaggcaaacataaggggagacatatttacccgagagcaagaagaagcactatggcatatcctatactcggtcgaagaccgttacgaaatcgtaaaagcactgcagagcttcgcagcaaaatacaggtttaacgacgacttcgtaacagttttctcaaaatttcccccgttcaagaaagaatacggttcctacagcgccaaagcgattaagaaacttctccctttaatgcgcatgggaaaatactggagcgaagccgcaatagacatcaaaacgcgtgagcgaatagagaaaataatcaccggcgaatgcgacgatagcatacgcgaacgagtacgcctgaaagcgattcggctgcacgacatcggagacttccgtgcactgccagtatggttggcatgctacgtcgtgtacgaccgacactcagagtccggcgacatcactaaatggaagaccccgcaagaaatggattggtatatccaaaacttcaaacaacactccctcagaaaccccatcgtagagcaagtgataaccgagacattacgagtagtacgagacatctggaaacaggtaggccggatcgacgagatccacgtagaactcggaagagagatgaaaaacccagcagacaaacgcgccaagatgaccgccagaatgatcgaaaacgaaaacaccaacctccgcatcaaagcaatgctaaccgaatttctcaacccggagttcgaaatcgaaaacgtgaggccatattcggcatcacaacaggacatcctacgaatctacgagaacggcgtattaaacagcgtgtcagaaatcccggaggagattaccggcattctaaagaaattcaacgagcgggagcaaaggaaacgcccatccacctccgaagtcctacgttacaaactctggcttgaacaaaaatacagaagcccgtatacaggcaaaatgatacccctcgggaaactgttcaccccagcgtacgaaattgaacacataatcccacagagccgatacttcgacgattccttcaacaacaaagtaatctgcgaagccgaagtaaataagctgaagggaaacctgctaggctacgagttcatcaagaaacaccacggacgccgagtggacctcggcttaggcgagatcgtcgacatattctccgtcgacgagtacgaaaccttcgtcaaagattattacagcgctaaccaacagaaaatgaagaagctactgatggacgagataccggaacaattcatcgaacgccaactcaacgactcccgatacataagcaaggtcgtaaaaagcctgctctccaacatcgtgcgcgaacaagacgagcaagaatcgatttcgaaaaacctcatcgtctgcaccggcggcgtgaccgacagactaaagaaagactggggcatcaacgacgtctggaacaaacttatcctgccccgattccagcgactcaacaacatcaccgagacaaccgagttcactgcgaaaaacatgcaaggccacgagatacccgtagtccccttcgaataccagcgaggattcaacaagaaacgcatcgaccaccgacaccacgcaatggacgccattgtcatcgcgtgcgccgggcgcaacatcgtcaattaccttaacaatgaatctgcccgcaagaaagcccaaatttcgcgatacgatctccaacgactcctctgcgacaaagtgaaaacagacgacaacggcaactacaaatggattctgaagaaaccctggagcaccctaacccaagacgtatacgcggcccttgacaacgtaatagtctcgttcaaacagaatctcagagtaataaacaagaccaacaaccactacgtccattacgaggcgggaaagaaaatcatcgccaaacaagagaaagcgagttgggcgatacgaaagccaatgcacaaggacaccgtcttcggcgaggtcaacctccgtaaagttaagaccgtgtcactaaacgaagccatcaagtccccgcactgcatagtgcaaaaggactttaagaagaaactactttcgctccttaaacaaaacttcgatgctaaagaggtcaaggcttacttcgaggaacacaaagacgtatggtccgacatcaacctaagcaaaatcgaagtatactacttcacaaaagacacaaaggaaagatttttcgcaacccgtaaaccactcgatagtagcttcgatcgcaagaaaatagaatcagtgacagacacaggcatccagaaaatcctcctaagacacctcgaacagaaaaacggagactccgacctagccttctctcccgacggcatcgaggagatgaaccaaaacatcgtccaacttaacgggggcagaaaacaccaaccgatcgtaaaagtgcgagtgtacgagaaagcggataaattcgcgatcggccagcagggcaataaggcttcgaagtatgtagaagcagcaaagggaaccaacctatttttcgcagtctacgaagaagaagtccgagacaaaaagacaaacgccgtcatgttcaaacgaaattacgcgtccataccactcaacgtggccatcgatcgacaaaagaaaggactctccaccgcccccgaagacgaaaacggcaacgcccccatatttgtgctcagcccaaacgacctggtctatctcccaaccgcagaggacatcatcaacgcacgtatctctttcccgataaacaaaaacagaatctataaaatggtctcctgcacgggctatcagtgcttcttcattaaacaccatgttgcgaatgtcatcgtcgacaaaaaggagttcagcgccctcaacaaaatggagaaagcagagacgaacgaaatgatcaaagacatctgcgtaccaatcaaactggaccgactcgggaacatcgtaaaaataggcgtctacaagtga

SEQ ID NO: 6925 - RNA, 4587 nt, synthetic construct
  misc_feature 1..4587: note = Cas9 variant
  source 1..4587: mol_type = other RNA
atgaagaaaatcctgggactggatctcggcaccaatagcatcgggtgggcagtcgtcaacagcttcgatgaaaaccagaacgaggagtcgctaaagcatatagagtgcgtaggcagcaggatcataccgatggacgcagccatactaggtgactttgataaaggaaacagcataagccagacagcgaagcgaaccgaatttcggagcgtacgccatctgcgcgagcgacacctcttacgccgcgctcgcctccacaaaatacttagcttactaggctttttacccgaccactacgtccaagacctcgactcacatggtaactttcccgtaaacgtcgaaccgaagatcgcatggcgcaaggactccaacggcgcattcgaatttatcttcaacgacagctttgacgaaatgctgcaagattttgcaacataccaaccagaactaatcgcatgtaacaagaaagtcccctacgactggacaatctactacctacgcaagaaagccctcaccaagaaactaagcaaagaggaactctcctggatcctacttaacttcaaccaaaaacgcggctactatcaactgcgcggtgaagaggatgacgaaagcgtcaaaagcgccaaaacgcggcaatacttcgaccgtcagaagatcaagtccatcgtggacactaaccaaacatacaaaggccaaaaggttctcatagtcgagcttgaagacgggatcaaaggaaagatattcaagaaagaaatcccgaattgggtcggccaggaaaaatcaatcatcgtaacaatagacatagataaagacggctgcgacaaatacgaagaaagcggagaactgtcctgcagattcaagatcccctcggatgccgaatgggaatccgaatggaagctaatcaagatgaaaacccaaaaggatctcgacgcctcaggcaagaccgtgggcgcctacatttatgacgccatactccagaacccaagccaaaagattcggggaaaactcgtccgaaccatcgaacgtaaatattacaaagaggaactcaagcaaatcttaaagaaacaagtagagttccacccagaactcagggacaaagacctgtttctcgactgcctcaacgaactataccccaacaacgatgcgcaccgtaacgcctgcgccgacagagacttcatctatctcttcatggacgacattttattttaccaacgcccactaaaaagcaaaaagagcctcatcgcggattgcccatacgagaaacacatgtaccgcgataaggaaactggcgaactcaaatactcctccgtcaagtgcatagccaagagccacccactcttccaggagttccgactctggcacttcataagtaacatccgcatataccaaaaagaacgagtcgtcgacgtcgacgcgtgccagccagacctctcaagtgcccgaagcgcactcaaaagtaagctagaagccgacgtcgacgttaccaacgaatttttaacatgcgaagcagactacgtaagcctgttcgagtggttgaacaataaaaagagtgtgagccaaaaggacttcctaaaatacccagccttcggcatcaagaaatcaggcgacaactaccgttggaactacgtggaagacaaatcctatccctgcaacgaaacccgcgcactgatcctcagccacctagaaaaagccaacatacgcggcgacatcttcacacgcgaacaagaggaagcactctggcacatcctatactctgtagaagacaggtatgaaatcgttaaagccctccaatcgttcgcggcaaaataccgattcaacgacgacttcgtcactgtattcagcaagttccctcccttcaagaaagagtacggctcgtactccgccaaagccatcaagaaactcctccccctcatgaggatgggaaaatactggagcgaagcggccatagacatcaaaacgcgagaacgcatagagaaaatcatcacaggagaatgtgacgacagcataagggaacgcgtcagactcaaagcaataagactgcacgatatcggcgacttccgcgcactcccagtctggctcgcatgctatgtcgtctacgaccgacactccgaatccggagacatcacaaaatggaagacaccccaagaaatggactggtatatacagaacttcaagcaacacagccttcgaaaccccatagtagaacaggtcataaccgagactctgcgggtagtcagagacatatggaagcaggttgggaggatagatgagatccacgtcgagctcggccgggagatgaagaaccccgcagacaaacgcgcaaagatgacggcccgcatgattgaaaacgaaaacactaacctgcgcataaaagcaatgctcaccgagttccttaaccctgagttcaagatcgaaaacgtccgtccctactcggcgagtcaacaggacatcctaagaatctacgaaaacggcgtgttgaactcggtaagcgaaatacccgaagaaattaccgggatactaaagaagttcaatgaacgcgaacagcgaaagagaccttccaccagcgaagtccttagatacaaattgtggctcgaacagaaataccggagcccctatacaggcaagatgatcccgctagggaaactgttcacgccagcctacgaaattgaacacataatcccccagtccagatatttcgacgactcgttcaataacaaagtcatatgtgaagccgaagtcaacaaattaaaagggaatctactggggtacgagttcatcaagaaacatcatggacggcgcgtagacctcgggttgggggagatcgtcgacatattctcggtggatgagtacgaaacctttgtgaaagactactactctgcaaaccagcagaaaatgaagaaactgctaatggacgagattccggagcaatttatcgaaaggcaactgaacgactcccgatacatatccaaagtcgttaaaagcctgctcagtaacatcgtccgggaacaagacgaacaggaatcaatctccaaaaacctgatcgtctgcacgggaggcgtaacagaccgtctaaagaaagactggggcatcaacgacgtgtggaacaaactcatactcccgcgtttccaacgtcttaacaacataacggagaccaccgagttcaccgccaagaacatgcaaggacacgagatccccgtcgtccctttcgagtaccaacgcggattcaataagaaacgcatagaccaccgccatcacgccatggacgccatcgtaatcgcgtgcgccggacgtaacatagtaaactacctcaacaacgagtcagcaagaaagaaagcccaaatctcccgatacgacctacagcgcttgctctgcgataaagtaaagaccgacgacaacggcaactacaagtggattcttaagaagccctggtcgaccctaacccaagacgtgtacgcagctctagacaacgtcatagtgtcctttaagcaaaatcttagagttataaacaaaaccaacaatcactacgtacactatgaggcaggcaagaaaatcatagctaagcaagaaaaagcctcctgggcaatccggaaaccgatgcacaaggacaccgtcttcggcgaagtcaatctacgaaaagtaaagaccgtgagcctcaacgaagccatcaagtcaccgcattgcatagtacaaaaagactttaaaaagaagctcttaagcctcctgaagcaaaacttcgatgcgaaggaagtcaaagcctatttcgaggaacacaaagacgtgtggtcggacataaacctgtcaaaaattgaggtctactactttaccaaggacaccaaagaacgctttttcgctacgaggaagcctctggattcctctttcgacaggaagaaaatagaatccgtcaccgacaccggaatacagaaaatcctgcttcggcacctagagcagaaaaacggcgactcggaccttgccttcagccccgacggaatagaggagatgaaccaaaacatagtccaactgaacggcggccgcaaacatcagccaatagtgaaggtccgtgtctacgaaaaagcagacaagtttgccatcggccaacagggaaacaaagcctccaagtacgtcgaggcggccaaaggaaccaacttattctttgccgtttacgaggaagaagtacgagataagaagacaaacgcagtcatgttcaaacgcaactacgccagcatcccactaaacgtcgccatcgaccgccaaaagaaaggcttatcaaccgcccccgaggacgaaaacggcaacgcacccatattcgtcctcagccccaacgacctggtatatctccccaccgccgaagatatcattaacgctaggatctcctttcccatcaataaaaacaggatctacaaaatggtctcgtgcacgggttaccaatgcttcttcatcaaacaccacgtagcaaacgttatcgtggacaaaaaggagttctccgcccttaacaagatggaaaaggccgaaacaaacgaaatgataaaagatatctgcgtacccatcaaactagaccgcttggggaatatcgtgaagattggagtctacaaatga

SEQ ID NO: 6926 - RNA, 4590 nt, synthetic construct
  misc_feature 1..4590: note = Cas9 variant
  source 1..4590: mol_type = other RNA
atgaagaaaatcctcggactggacctgggtacaaattcgatcggctgggccgtcgtcaacagcttcgatgaaaaccaaaacgaggagtcactcaaacatatcgaatgcctaggcagccgaataatccctatggacgccgccatcctcggagactttgacaaggggaacagtattagccaaaccgccaaacggaccgagttccgaggcgtacgccacttgcgagagcgacatctcctgagacgcgcgcggctccacaagatcctcagactattagggttcctccctgaccactacgtccaggacctagacggccacggcaacttcctggtcaacgtcgagccaaaaatagcctggcgcaaagactctaacggcactttcgagttcatctttaacgactcattcgacgaaatgctccaagacttcgccacctaccagcccgaactcatcgcctgcaaccgaaaagtgccctacgactggaccatctactacctaagaaagaaagcactcactaagaaactctccaaagaggagctgtcctggatcctcctgaacttcaaccagaaacgcgggtactaccaactccggggcgaagaagacgatgaatccgtaaaaaccgcaaaaacacgccagtacttcgatcgacagaaaataaaatcgattgtggacaccaaccaaacgtacaaaggccaaaaagtcctaatcgtggagcttgaagacggagtaaagggcaaaatattcaagaaagaaatcccaaactgggtcgggcaagagaaatcgataatcgtcaccgtagacatagataaagacggatgcgacaaatacgaagaaagcggagaactgtcctgccgattcaaaataccctcagacgccgaatgggagagcgaatggaaacttatcaagatgaagacccagaaggacctggacgcctcaggcaaaacggtcggagcttacatctacgacgccatcctccaaaacccgagtcaaaagatacgtggcaaattagtacgtacgatagaacgaaaatactacaaagaagaactcaaacaaatactcaagaaacaagtcgagttccaccccgaacttagagacaaggacctattcctagattgcctaaacgaactctatcccaacaacgatgcgcacagaaacgcctgcgccgaccgcgacttcatataccttttcatggacgacatcctgttctaccaacgccccctaaagtccaagaaaagcctaatagcagactgcccctacgaaaagcacatgtaccgggacaaagaaacaggcgaactcaaatactcctcagtaaaatgtatcgccaaatcgcacccactcttccaggagttccgactctggcacttcatctcaaatatacgaatataccaaaaggaacgcgtaatcgacgtggatgcatgccagcccgacctgtcaagcgcccgatcagcactcaaaagcaaactcgaagccgatgtcgacgtaacaaacgagttcctcacttgcgaagccgactatgttagcctgttcgagtggctgaacaacaaaaagagcgtcagtcagaaggacttcctaaaatatccggccttcggaatcaagaaatccggggacaactacaggtggaactacgtagaagacaaatcatacccatgcaacgaaacacgcgcacttatactctcccatctcgaaaaggcaaacatacggggcgatattttcacccgcgagcaggaagaagccctatggcacatactatatagcgtggaagaccgctacgagatagtgaaggcactccagtctttcgcagcaaagtatcgattcaatgatgacttcgtaaccgtgttcagcaagttcccgccgtttaaaaaggagtatggcagctacagcgccaaagccatcaagaaacttctgccgcttatgaggatgggcaaatactggagcgagagcgccatcgatatcaaaaccagagaaagaatcgagaaaataatcaccggggaatgtgacgactcaatccgcgaacgcgtgcggctcaaagcaatacgcctccacgacatcgaacactttcgtgcccttcccgtctggctagcgtgctacgtagtatacgaccggcacagcgagagcggcgacatcatgaaatggaaaacgccccaggagatggacagctacatccagaactttaaacagcactcactcagaaacccgatcgtcgaacaagtcattacagaaacccttagggtagtccgcgacatctggaaacaagtcgggcggatcgacgaaatacacgtcgaactaggccgagaaatgaaaaaccccgccgacaaacgaaaagagatgaccaaaaggataatcgaaaacgagaacacaaatctacgaataaaggccatgttaacagaatttctaaacccggagttcgaaatagaaaacgtccgaccttacagcgcgtcacaacaagacatactacgcatttacgaaaacggagtactaaactccgtctcggaaatccccgaagaaatcaccggaatactaaagaagttcaacgaacgagaacaacggaaacggccaagcacttcggaagtgctccgctacaaactctggctggaacaaaagtattgcagcccctacacggggaaaatgatcccgctcggcaaactgtttacgcctgcatacgaaatcgagcacgtgataccccagtcacggtacttcgacgatagcttcaacaacaaggtaatctgcgaagccgaggtaaacaagctgaagggaaacttactcgggtacgagttcataaagaaacaccacggacaaagggtagacctcggcctaggcgaaatagtggacatattcagtgtcgacgaatacgaaacattcgtaaaagactactacagcggcaaccagcagaaaatgaagaaactgctaatggatgaaataccagaacaattcatcgaaagacagctaaacgattctcgctacataagcaaagtcgtgaaatcgttgctctcaaacatcgtccgagaacaagatgaacaggaatcaatcagcaaaaacgtgatcgtctgcacagggggagtgacagaccggctcaaaaaggactggggaattaacgacgtatggaacaaactcatcctaccacgattccaacgacttaacaacatcaccgagacaaccgagttcactgccaaaaatatggaaggacacgagatcccagtcgtacccttcgagtatcagcggggcttcaacaagaaacggattgaccaccggcaccacgcaatggacgctatagtgatcgcctgcgccagtagaaacatcgtaaactacctaaacaacgaatctgctcgaaagaaagcgcgcatctctcgctacgaccttcaaaaactcttatgcgacaaagtccgcacagacgacaacggcaactacaaatggatactaaagaaaccatggggaactctaacccaagacgtctacgcggcactagataacgtaatcgtatcattcaaacagaacctgcgagtcatcaacaaaacaaagaactactacgtccactacgaggcaggcaagaaaaccatcgcgaagcaggaaaagggcagctcctgggcaatcaggaaaccaatgcacaaagacactgttttcggtgaagtgaacctacggaaagtaaaaacagtctcgctcaatgaagcaatcaaaaacccccaatgcatagtagaaaaagacttcaagaaaaagctgctctccctactcaaacaaaatttcgacgcaaagaaagttaaggcgtacttcgaagaacacaaagacgtgtggtccgacataaacctcagcaaaatcgaggtatactacttcacaaaggacacgaaagagagatttttcgcaacacgcaaacctctagacagctcctttgataagaaagaaattgaaagcgttaccgacacagggattcagaaaatactgctaagacacctcgaacaaaagaatggagatccggacctcgcgttctcccccgacggcatcgaagaaatgaaccacaacatcgtccaactaaatggtgggcgaaagcaccaaccaatcgtaaaagtgcgcgtatacgaaaaggccgataagttcgccattggccaacagggaaacaaaagcagcaaatacgtcgaagctgccaagggaactaacctgttcttcgcggtttatgaagaagaagtacgagacaagaaaacaaatgcagtgatgctcaagcgacattacgcgtcaatcccgctcaacgtcgccatcgaccggcaaaagaaaggcctcagcactgcgccagaagatgaaaacggtaacgtacccatcttcgtactatccccaaacgacctcgtatatctccccactgccgaagacatagccaacgcctccatctcgttccccatcaacaaaaacaggatatataaaatggtcagctgtaccggcaacagatgcttcttcataaagcaccacgtcgccaacgtcatcgtagacaagtccgagttctcagttctgaacaaaatcgaaaaagctgaaaccgacgagatgataaaggaaatctgcgtccccatcaaaatagacagactgggcaacatagttaaaatcggggtctacaaatga

SEQ ID NO: 6927 - RNA, 4608 nt, synthetic construct
  misc_feature 1..4608: note = Cas9 variant
  source 1..4608: mol_type = other RNA
atgaacaccatcctcggcctcgaccttggaacaaacagtattggatgggctctaattaaggttctaaacgacaagacacgactcccactagaaatcatagacctgggagtagtcgtcatcccgaccgaccaacgtaccctagacaaattctccaaaggagaatcgatctcgaagactgccgaacgcacaaagcaaaagggagtacgaaaactctacgaaagaaagaaacttcgacgcgagcgactccacagagtcctaaacatcctaggcttcctgccggaacactatagcaaaaagatcgacttcaagaaacatctcgggcaattcttcggcaattcccagcccaagatcagctacgtcgaaaacgatcacgggaagcacgagttcatcttcatggactcctaccgagaaatgctcaaagagttctctaagcacaatataaagaacgtgccctatgattggactatatactacctccgcaaaaaggccctgagccaaaagatcagcaaggaagaactagcatgggtcattctgaacttcaacaagaaaagaggttactaccagttccgcgacgataacgcagacgagaacaaagaaaataaaatcgaaaagtactacgcactaaaagtgaccaacgtcaaaaaggaagacgcccaaaactacacaatcactcttgaaaacggatggatctacaaaaataagtccaagataagccttctcgactgggtcggcagcacgaaagagttcatcagtaccgaaaagtttgacaacaaaggcaacattatcaagaagaaaaacggcgaagacgaccgaacactcaaacttgttgacagtgaaaaggactggatcgcaatcaaaaagagcacggaagaccggatagagaactacggaaaaaccgtcggcacctatctgtacgagcatttgcttaaagaccccaaccagaagctaaacggcgagcttataaacatcatcgaccggaaattctacaagaacgagctaaaacagatccttgagaaacaaaaggagttccaccccgaactcctgaacgaagatctattccagaaaagcataatagaactctaccctaaaaactccacccgccaaaaggagcttaaaaacaaggacctatgctacctcttgatagacgacgtcatctattaccaacgcgacctaaagaagaaaaactcaacgatcaacaaatgctccttcgagtcccgcgagtactacttaaacggagaaaaacagatccagaaaataaactgcattgcaaaatcgaaaccactctaccaggaatttcgtacactccagttcataaagaacctaaaagtgtacgagattatcgacggactagaaaaagacataacttcgaaacttcttcccgacttcgagacaaaagagcacttcttcgagtggctaaacgacaaagagaaaatagaccaactacagctcctgtcctacaagtgctttgacctacacgacaacgtcaagaacgatctgatagccaaaggcatcaagcggcccaccgaaaaggccatccgcacggagctactcgaaaaataccgctggaattacagcaaggataatgaccgcaacttcctactcaacgaaacccgctttaaaatcctaaagtaccttaagaaagtagacaagaaactaaccctcacgaacgaacagatcgaatccctctggctcctactctatagcgcaaaagacgaaagagaacttaaaaatggcctgcaaaaattctccgaaaagaacaaactcccaaagaagttctcggatatcttcatctccttcccgccctttaaaaaggagtacggcgcttacagcgaaaaggccctcaagaaactcctgagcttggtccgattcggaaaatactggtcgttcaacaaaatagacaacaacatacagaacaagataatgaacattctcaacggagaagtagacgacagcatatccgaccgcgtgcgggaaaagacaatcctgcttcaagacaaaaacgacttccaagatctacccctctggctagcctcctacgtcgcatacaaccgattcagcgaagtaagcgagataaaatactgggactcacccgacaaaattgagttcttaaaacaacactccataggcaacccgatcgtcgagaaaataatcaacgaaacactcaagctcatcaaagacatctgggtgattcatggaaaatcgtgcaaaaacttcttctcggaaatacacatcgagctctcgcgcgaaataaagtcatcgtccaagaaacgagcgcaaatcaccaacaacaatacgaaaaaccagaagctaaataacctcatcaagtccctcctcatagaaatggcctccgacaccaaatacgagaatgtcaccccatactcgccgtcacaacaagagatactcaagatctacgacgagggcatctactccaaggaggagaacagcgaaaagataaaagaaataaacaagatccgtaataacaataaaatatcgaagtcagacataacaaaatacaaactttggctcgaacaaggctacatctccccctacacgggaaagatcataccgctcaccaagctgtttactgccaaataccaaaaagagcacatcatccctcaaaccaaattcttcgatgactcgttcaataataaagtaatatgcgaagcagaggtgaacaaactcaaagacaatagcctagctatgaacttcatcaaagccaaaggcgggaaagccgtaaaactctccgacggagaaacagtcacgatcctcaaccaagaagagtataagcaactcgtccgcacatcattcaagaaaaatagcataaaactacggaaccttctcctggaagaaatacccgacacgttcacaaaacgtcagcttaatgacacgaaatacattagcaagctagtgctctccctcctcagcaacatagtccgagaaaaaggcgagctggaatcgaccgccaaacgcatcgtctccacaaacggacaaatcacctccatcctgcgcaatgactggggtctgaacaacatatggaacaaactaatcacacccaggtttgagcgactcaataacatcaacaaaaacaagatctacggcaactgggaaaacaagaaaggtaaaaacgtatttcagattaactacctcaacgataacctatccaccctaaacacaaaaaggatcgaccaccgccaccacgcactggatgcgctaatagtggcctgcaccacccgaaaccatataaacttcctcaataaccaatacgccaaaagtcgcaaccaacgccacgacctccgggccaagctcaaacgacgagaaacaatcacgacagaaggttccaagaaacaagtctttaaagacttcataaaaccatgggagagcttcacgcaagacgcactaaagaaactagagaccaccatcgtgaacttcaaggtcaacaaacgcatcataaataagaccatcaactggtacaagaaatgggaaaaacaaaaagacggcacctataagaaaatccaaaagaaacaaaccaaaggggatgcgtgggctatccgaaaaccgctgcatatcgataccatctatggaatagtatgcaagaaacttccgctcaaaagcgccctggaaaactacaaaaacatcatcgatgaaaaccttaaacacaaaatcaaagagctcaaagaggttaacaaattcgacaacaaccagatcattaacttctttaaggaatgcaatttcatcttcgaggataacaacatccaaaaagtagaggtgtacgacttcaaggacaaccgagacaaaacaatactctccagctcgcgccagctgatagatgagagctttactcccaaaaagataggtaaggtactcgacccaaccattcgaaacatactactgaagcacctgaacagcacgaaatataacaacaagttcgactccgatggcaatccaattaaaccagaaaaactagctttctcgcccgaaggcctaaaagacctaaacaaaaacataaaacacctcaacaacaataaagaacaccaaccgatcaaacgcgttaaactgttcgagacgctcggaaataaaatcaaagtcggctacacacagcagaagaacaagaaattcgccgagaccgcgacaggaaccaatctcttcctcggtatatactccgataacaacaaacgcgacttcaagacaatcccgctcatcctggcaatccagcgtgaaaaggagggactgaatccgtgtcccgacaccgacgagaagggcaaccaactcttattctcactatcccccaatgagctggtcttcgtacccaacaacgaggaacgaaagaaccccaacctcgtagatttcgaaaacctatccaaagaccaaatcgaccgaatttacaaatttgtcagctgtactggcagcgaggcctacttcgtcccctcacggacagcgaagccaataattgagaacgaaaacggcactaacaacaagagccaaaggatcatcgaatttaatgagaaaacctccattaagaacgagaaaaacgaaccagtgctaatcaagactatatgttggaaaatcgaagttaaccgactaggcaaaatcatcaaagtcattaaatga

SEQ ID NO: 6928 - RNA, 4608 nt, synthetic construct
  misc_feature 1..4608: note = Cas9 variant
  source 1..4608: mol_type = other RNA
atgacgaaaatactcggacttgacctgggcacgaacagcatagggtgggccattcgggacacggaaaacgaaggaataaatcagatactcgacaaaggagcccggatattttccgaaggcgtgaaatccgaaaacggtaaagaaataagccgagcagcggaacggacggcataccgaagcgctcgtaaaataaaataccgcagaaaattacgcaaatacgaaacactcaaagtcctcagtataaacggcatgtgcccactcagcgtagaagaagttgaacagtggaagaaaagcggattcaaagaatacccactcaaccccgaatttctcgactggctgaggaccaacgaagacaaaaacataaatccatacctgttcagagacaaggccagcaaacaaaaagtaacactgttcgaactgggcagggccctgtaccacatcgcccagagacggggattcctcagcaaccggttagaccaaagcgcagaaggcgtcttcgaagaacacaacccccaaatacaaaacctcatcgaagacctagatagctccaacacaatactaaacgaattgaaagaatactatataaacctaggcataatcgacgaaaccgagaaaagcgggttcaagaaagacctggacgaaggcgagaagaaactaaaaagcctatacaactcactggttgcgataacaaagaaaaacgccaacgacatagaaacatgcaaacaagaactgatcgcacgcctcaacaagaaagaagacctcggcaaagtaaagggaaaaataaaagacatatcccaggccatgttggaccgtaacttcaaaacactgggacaatacttcttctccttatacaacaaggaaaggataagaaaccagtacacatcgcgagaagaacactacctggaagaatttataatcatatgccagacgcagggaatagagggcataaacacgaacgaaaaactacccgagaagaaattcaccggcctagcaaaagatttataccgggccatcttcttccaaaggcctctgaagagtcagaaaggcctcatcggcaagtgctccttcgagaaaaacaagtcacgatgcgccgtcagccaccccgactacgaagagttcagaatgtggtcgtatctaaacaccataaaaataggtacacagagtgagaaaacactccggttcctcaccctcgaagagaagctaaaactcgtcccaaaattctaccggaaaagcgacttcaatttcgaagtcctcgccaaagagctcgtcgagaaaggggcaagtttcgggtactacaaaagcagtaagaaaaatgagttcttctactggttcaactacaaaccgacggacagcgtgagtgcatgcgtagtcagcgcttcactggaaaatgcaatcgggaaggactggaaaataaagacattcgaataccaaacccgaaacacagagaaaaacgaggtcacaaaaagcgtcgactataaagatctctggcacctgttgtccgtggccacatccgacacctacctctacgacttcgcaatcgagaaactgaagctcgagcccaaaaacgcgaaagccttctcgaaaacgaagctgaagaaagacttcgcctctcttagcctagcggcaatagccaaaatcctcccatacctcaaacagggactcctctacagccacgcagtattcatggctaacatagaaaacatagtagacgccgacatctggaaggatgaggaacagcaaaagttcatccagagtaagatagtggagctcgtggataactacatcgtcgaaaaatccaaactagaactgatcaacggactgctcaaaatatacaacaccgaagacaaggaaggccggaaggtatactacagcaaagaagccgagagcttattcgaggccgacctccgcaagaagctagtgcccttctacaaggcaaacatcatcatagaggaacacgaacaagaaatcatattccaagacctgttcccaatactgatggaccaactcaagaaacaggagttcatcaaaatcggacgcctcgacaagcaaatcgaagcattcctcgagggcgagaacgaagaaggccagatattttgcaaccataccgacaaattgaagaaactataccaccccagcgacatcgaagtctttaaaaagaaaacgataaaagatgaatggggaaacgaaaaggtcgtactcggctctcccctcaccacctccatcaaaaacccaatggcgatgcgagccctacaccagctacggaaggtactaaacacactcatcgccaatgaccaaatcgacgaagacacgcggatccacatagaaatggcgcgggaactgaacgacgcgaataaacgaaaggggatacaagacttccaaaacgagaacaagaaattccgagaggaggccataaaggagataaagaaactgtaccttgaagaatgccacaaagacgtaaacccaacagaggacgacatcctacgctaccaactctggctggaacagggtaaatgcgagatatacgaagaaggaaacaacatttcgatatgcgatatcatcggcagcaatcccagctacgacattgaacacaccatcccacgcagcataagtcaagataactcgcaaatgaacaaaacactctgcagcctcaaattcaacaggtcgatcaaaaagcagaagatgccagttgaattgtccaactacaacgatatactgcccagaatcgcgcattggaagaaagaggctgaagaactcacccggcagatagaaacaatcagcaggtcgatcaaaagcgccgcaacaaaggtggcgaaagacaagaatataaggaaacggcactacctaacgctgaagagagactatatcctgggaaaatacgagaggttcacgtgggaggaaccaaaagtgggcttcaaaaacagccagatccctgacaccgggatcataaccaaatatgcgcaggcctacctaaagagctacttcaagagagtagagagcgtaaaaggaggtgcagtagccgagttccggaaactttggggaatccaagagagcttcatagacgaaaactggtggaagcactacaaagacaaagatcgcgacaagcacactcaccacaccatcgacgcaatcaccatagcatgcatgccaaaggacaaatacgacctactagcgcatgcgtggcggctcgaagacgaacaggacaagaaagcggcaaaagtcctaatcgaacaggcaaaaccatggaagaccttcaaggaggacatcgaaaagatagagaccgagatccttgtctcacactttacaccggacaacgtcaaaaagcaaagcaagagcataataaagaacaggggaaagaaggtctacgtcttgaaaaacgagcttccggtgaatttcaaaaacaaaatcgaaggcaaagactacttcaagctgaagttcgacagcaaaattctctacaaaattcctaaaaagaaagaaaagcaaaccgacacattctatgaggaactcccaaagaactacctaaacggagtcgagggaaaggactactttaaaatcaacactacgggcaagactttctacaaaatcccgatctttaaccaaggagacactataagggggagcctacaccaggaaaccacgtacggcgcgattaagctcccggacatagacatcgaaacaaagaaaccactgcacaccgacaaaggaggcttcatcctgaagaaagatatcaagggtaacgagatcgtattctttgtggtccggaaagaaatcagcaaaatcagcgaaaacgatgtgcaaaacatagtagacaacgtagtacggaagaaaatagagaacgcaatagcaaactccctaatcaccttcaaaatcgtcaagaaaaagaaagtcgccgtaataaaagaaggagtcactatatggatgcgggagccaaacatagagaaaggaatagagggaatacccatcaaaaaggtcagaatcatcacgaacagcgtcaaaaaccccatcgaaataaaggtacactccccactatcaaaatccagacacaagcacaaacaaaaagtttatggacaaaacgacgagaactacgcaatggccctatatgaactcgacggaaaacgggagttcgaactcataaataacttcaacctcgcaaagctcctaaagcaatcccagtcctattacccactacacaaagaaaaagagattaagggaaagaaaatcctagtgcctatcgagaaacggaataataaagatgtaatcctgaagcgcggacaacaggtggtcttctacgacaagacagtcgagaaccctaaggacatcagcgaaatcattgacttcagggagcgcatttacataatcgagggactcaccatccagcgacaaaaggacaagaaaacatccaaggtgaacgaatacggcatcatacagctaaggcacttcaaagaggcgcggaaaagcgaagaaatatccaaggacaacttcaaacccgacggtgagttcaagataaacgagaacaagcccacccgcaagatgaatcataaccaatttaccgccttcgtagaaggcatagatttcaaagtgctaccctccgggaaatttcagaagatctga

SEQ ID NO: 6929 - RNA, 4614 nt, synthetic construct
  misc_feature 1..4614: note = Cas9 variant
  source 1..4614: mol_type = other RNA
atgaaaaagatcctaggattagacctcggaacaaattcgataggctgggcactgactacaaatgacttcgacacgaagaaaggaaccatcgagggcctgggaagcaggatcatacccatgtcccaagacatcctaggcaaattcgacagcggcgtttcactcagccaaaccgcccagaggaccgagtaccggggcaagcgtcgcctagtccaacgattcctgctacgaagggaacgactccacagagtgttgcacattttagaactcctacccaagcagtactcagaggccatcgacttcgacaaaaagctcggccagttcaagccagagcgcgaacagaaaatcagcttctataaaaacgagtccgggaaaaaccaattcatcttcaccaagtcgcatcaagagatgctcaccgaatttcaaacctactaccccaccatcaaaaacatcccgtacgactggacaatatactacctccgcaagaaggcgctcacggagaaaatcagcaaagaagaactcgcatggatactactcaacttcaaccaaaagcgcgggtactaccaactgcgaggagaagaaaaagaagaaaacaaaaacaagaaagaagagtttcacacgctcctagtcacggacatcatagagagagacaaaggaaaatccgggacctggtacaatgtaattctcgaaaacggctggatatacaaacgcgagtcaaaaattagcctagcagactggataggcaaaacgaaatccttcatcgtgaccacggagtacaacgacgacggctcagtgaagctcaccaaagacaatgaggaaaagaggtcattccgttcccccaaagaagacgactggggcctgatcaaaatccggacagaaaagacaatcaaccaatccgacaaaagcgtcggggcctacatctacgacgccctactcaaaaaccctaaccagaagataaaaggcgaactggtgcgcacaatcgaacgcaaatactacaaagacgaactacgcgaaatcttaaagaaacaactcgagttccacagcgacgtacttaatgacaaaatcctctataagaaatgcatcgacgaactgtacaaaaacaacgactcgcacaaaaactcaataaaagaccgcgggttcgactacctctttctcgacgacatcatattctaccagcgccccctgaagtccaagacttccctcatctcggactgcagcctcgagttccggccaatcaaaaacaaaaacggcgtccttgtcaaagacaccgacggcaaacaaatagcaaaagcactaaaatgcatcgcacggtcaaatccgatcttccaagagttcagactcctgcagttcgtcaaaaacctcaaaatctacaagcgaggagtagtcgacgacgtcgaggtcactaacgactacctcaagtcagagaacgacgtcgagaaactatttaattggctaaacgataaagcggaaataaatcagaagcagtttctggtcaacttcaagctgaaggaggacaaacaccgttggaacttcgtagaagacaagggctatccatgtaacgaaacccgcaaccaattcctgaacgctatcgccaaaatcgacgtcgacaagtcctttttcaacacgaaaaacacacaagacctatggcacatactatactctgtcacggacaagattgaaataaccaaagccatcaccaccttcgcgaagagacacaatctacctaatgaatttataataaacttcagtaaaatcaagccctacaagaaagaatacggctcattctccgagaaagcgatcaagaagctgctacccctcatgcgcttcgggtcgtattgggacgctaaaaatatcgacataaagacactagatcgaattgacaaaatacagaccggcgagttcgacgagaaaatcaggaaccgagtcagagaaaaagccatagacttacacaaaatcgacgatttcaaagacctcccgctttggcttgcctcatacattgtctacgacaagcactcggaggcctcggacgtaagcaaatggaaaaccccagcggacatagaaaaattcctaaagcacgagttcaagcagcatagcctccgaaaccccatcgtagaacaagtcataactgaaaccctccgagtcgtgaaggatatctggctgcaatacggcgaagggaaagaaaacttcttcaacgaaatccacatcgagctcgggcgcgaaatgaagaacgacaaagccacccgcgaaaagatcagcaagaaagtctccgaaaacgagaatacaaacctacggataaaagctatcctaaccgaactcaaaaatgatggcgtgtctgatataaggccgtactccccttcccagcaagagatcctaaaaatctacgaggaaggtgtatacaacaacgaaagccgaaaagaaaaactagaagaggtcgacaaaatacggaaaaacgcgaagcccaccaccagcgagattatcaaatataagctctggctcgaacaaggctacgcatccccgtatacggggaagctgattccgatgagcgaactattcaccacgaaataccagatagaacacattatccctcagtcgagattcttcgacgacagcttatcaaacaaggtcatctgcgaatccgaagtaaacgagctcaagagcaacatgacggcgcttgagttcatcctaacaaacgaaaaccgtatcgtaactctaacgggcggagagactgtcaagatattcacaaaagaagcctataaccaacacatcatatcatactatagcaagaacaaaaacaaacaaaaacgacttctgacagaggaaatccctgaacaattcatatcacgacaactaaacgacactaaatatatcagcaagatcgtgaaaaacctcctgtccaaaatcgtacgagaagaggacgagcaggaagtaacttcgaaacacgtagtcagcctcaacggttccataaccagccgaatgaaacaagactggggcctaaacgatgtatggaacacgatcgtctcaccgcgcttcgaacgtctcaacacgctaaccaactcgaacgacttcgggcaatttgagctcaagaaggacgcttatggaaacgaggggaaacgcgtcttccaaacgacggtccctgacgccatagcgaaaggattcaccaagaaacgaatagatcaccggcaccacgccctggacgccctagtaatcgcctgcgtaaaccgaacacacataaactacctgaacaatctaaacgcaaaagacacggacgacaaagcagtgaaacacgaactgcgcaacaaattatgcttcaagaccaagccagactcaaacggaaactacaaatgggaatttcacaagccgtgggaaaaattcactaaggaggcgcaagacaaactaaacacaacgatagtcagtttcaagcagaacactagagtgattaacaagactgtgaacaaatacgtaagctataaagacgaaaacggaaaccttaacgtggatgcaaacggactaccccagaagaaagtgataacccaaacaaagggggacaactgggcaatccgaaaacctctccatgcagaaacggtctccggcaaggtcttcctcaaacggataaagcagtcacacatcaccatcgctaatgcgatcgaacaagtggaattgatagtcgacaaggaagtcaagaaacaactaaaagccaagattaagctctacccgaacaacatagccggcctaaagaaacacttaaaagcgtttcctgtcatgataaacgacaaagccatcgataagatccaaatatatgagacgctcgaggccaccgccacgcggaaaatactagacattacatttgatgaaaagaaaatacagaaaataacggacacaggaatacagaaaatactccttaaccacctaaagcaagagaaataccaaaacaccgtcgacgaaaacggaaagaaactggcgccccacgagatagctttctcggaaaacggcctcgaagatctgaacaaaaacatcaccttcctgaacgacgggaaaaaccaccaaccaatcaaaaaggtgcggatatttgaggaaggaaacaaattcccgctgggggaagtgggcaacaaaataaacaaattcgtagagaccgccaaaggcacaaacctattcttcgctgtatatgaaaatgacgacaagaaacgaaactacaaaaccataccattcaatgaggtcatagagcgccaaaaacaaggactgaatgcagcccttgaaatagacgaaaacgggaaccgcctcctattcacactatcccccaacgacctcgtatacatcccgctcgaggatgagattggttacctcaacggagtgtactttaaaaacctcaacaaagagcagaccgtcaggatctacaagttcgtcagttgcaccggcggagaaggacacttcgttccgaacaactacagcaaagaaattatctcaaacgagaacgggagtaacaataaaaacgaacggatgctcaacttcaacaacttcaacatcatattcgatggaaaagaaaaaccggtcatgataaagagcatctgctggaagctcgaagtcgaccggttaggaaaagtaataaaaatcataaaatga

SEQ ID NO: 6930 - RNA, 4617 nt, synthetic construct
  misc_feature 1..4617: note = Cas9 variant
  source 1..4617: mol_type = other RNA
atgaaacacattcttggcctggacctaggaaccaactcgatcgggtgggcgctcgtaaaaagcgaacaagactgcgacgacgttgagaggattaacggaatagaagccgccggcagccgtatcattcccatggatgccgctgttctgggagattttgcaaaaggaaacaccaagagccagacggctgaccggactgccgccagagggatacgacgaatgggagaacggcacaagctccgccgggaacgcctgaaccgggtattggacgtaatgggattccttcccgaacactacagcgccgcgctcacccgctacgggaagttcaaggacggcgaagaatgcaagatagcatggcgcaaagacgagagcgggcaatggaccttcgtattcgaggactccttccgggaaatgctcgccgacttcgtcgcccaccagcccgaatggctggccgggggcaggaaggtgccttacgactggacaatttactatctgcggaagaaagcactatcaaagcctctgacaaagcaagaactagcctggctactactaaactttaaccagaaaaggggatactaccaactgcgaggcgaagacgaacatacagacgacaaaggcaagctagtagaatactacgcactcaaagttgttggagtcgaggatacaggcgacaagaagggcaaagacacgtggttcaacataatgctagaaaacggcatggtctaccgtagacctgcagccgaagcaccggactggatcggcaaaacgaaagagttcatagtaacgacggacctagagaaggacggaaccccaaagaaagacaaggagggcaacattaagcgatcgttcagaatgcccaaagaagacgactggaccctcatcaaaaagaaaaccgaaaacgacatcgataggtccgggaaaactgtaggcgagtacatctacgacgcactcctagcagacccgacccagaaaatccgagggaaactggtgcgcacggtcgaacggaagtactacaaagaggaactaaagaaaatcattaacagccagaaaagattcatacccgagctaaacgataacgaactatacggccgatgcataagtgaactataccaaagcaatgacgcctacagacaaagcatctccagctgcgactttacctaccttttcgtagacaatatcatattctatcaacgcccgctgaaaagcaagaaatcactaatcgacaactgcccatacgaggagcacagctatacagactcgaaaaccggcgaggtaaaaacggcacccgtaaaatgcgtcgcaaaaagcaacccacttttccaagagttccgcctgtggcaattcgtacaaaacatccgcatatttgaacgccagaaaaagatcggggattcagtcaagactgacgtcgatgtcacgggcgagttcataaagtcggccgatgacgtggtctccctattcgacttcctgaacgacagaaaggacatcacccaaagcgtcctactcggaacatactttaagatcaagaaaccaaaagggaaagactcagactacccatatcggtggaactacgtggaagacaaaacgtacccctgcaacgaaacacgtgcgctaatattgaagggtctgaaagacgccggcatcgacgagggctttctcgacaaggacaaagagtacagcctctggcatatactatattcggttgaagacaaacaagagatcaccaaggccatggaaaagttcgccgctaaaaacagtcttggcgggaaattcgcagaagttttcagcagcttacctccattcaataaaaactacgggtcgtactccgaaaaggcgatcaagaaattactggctctcatgcgaacgggaaaatactggtcggcagacgctatagacaaacacaccctggaacgtatagacaaaataataaatggcgagtacgacgaaagcatacgtaccagagtccgggaaaaagcaattaacttgacagacgtgtcccactttagagggctacccctatggctcgcatgttacatagtctacgaccggcacagtgaaagcaaagacataacctgttggaactgtcccgcggacatagaccaatacttagaccacttcaaacaacacagcctccgaaatcctatcgtcgagcaagtcgtgactgaaacactgcgaacagtccgggacatctggcgacaatacgggaagatcgacgagatacacatcgagatgggacgcgacatgaagaaccccgccgacgtgagagccaaaatgtcaaaaagaatgatcgacaacgaaaacgccaacctgaggatcaaagctatgttggccgagttcgcagacccagactttgggatcgcaggcgtccgaccatacagtccatcacaacaagaaatgcttagaatctacgaggagggcgccctcgaatccgtagacgaagtacccgacgagataaacgagataatctcaaaattcaaccaaacagacatcaagaaaaggccaacccacggagaaatcataaaatacaaactctggctcgagcaaaaataccagagcccatacactggaaggacgatatcccttagccgcctcttcacggacgactaccagatcgagcatgtgataccccaaagtagatacttcgatgacagtatgtccaacaaagtgatatgcgaagcggaagtaaaccagctcaaagatcgaatgctgggctacgagttcataaaggcgcaccacggggaaaaagtattgctatctagtggcgaaacggtaacgatccttacagcggaagaatacgaacgcctcgtacagttgaattttcgcaaaaaccccgtaaaaatgaaaaagctgcttatggacgacatccccgacaagttcatagaacggcagctcaatgacagcaggtacataagcaagaaaatcaaatcactgctatctaacatggtccgcgacgaaggggaacaagaagacatctccaagaacgtaatagcgtgcaacggagcaatcacagaccgacttaagcgggactggggagttaacgatgtctggaaccacatcatacttccgagattcgaacgtctgaacgcggtcacgggctcggaccggttcaccacaaccagtaccaacgggcacacgatccccgacatgcctctaaacctgcagaagggcttcaacaagaaacgcatagaccaccgccaccacgcaatggacgccatcgtcatcgcatgcacaactagaagccacgtgaacctgctcaacaatgaggcggcaatgagcaagaacaacgcagtgcgataccaactaagccgtaaactccgcagatacgaggataccatggtcacgagaaacggagagacgaggacgatatcggtcgcccgggagtttttaaagccttggccgaccttcaacgcagacgtcgagaaagccctgagaggcatcgtggttagctttaaacaaaacctcagagtaataaacaaaacggtaaacaagtaccaaaagttcgtctacaacgaagaaaaacacattaaggagaaaaaggcagtaaggcaggaggaacgaaacggaaggcacctactcgccatcagaaaacccatgcacaaggatacagtatacggtgaagtcaacctcaggcgaatcaaagaagtatcgctcaaggacgcagtcgccaaccccaaagccgtcgtggacaaagacctcaagaagaaacttatggccatgatcgaactagggtatgacctgaaacaaataaccaaatatttcgaagacaacaaggacgcctggcaggatgtcaacttaaagaaaatcaaagtctactacttcactaaagacaccggtgaccggtatttcgccacgcggttcggaaacgacctggtcaccctcttctccaagataacgaaagccgacgatgcgaaaaagcaaatagaacgaataacagacacaggaatacagaaaatactcaagagacacctcgaggcgaacgggggcgactgccaaaaagcattctcggcggacggcatcgacgaaatgaaccgaaacatcacgcaactaaacggagggagaccacacaaaccagtatacaaggtaagaatatacgaaaaggccgacaagtttgcgatagggaccaaaggaaacaaagcggcaaaattcgtcgaggccgccaagggcaccaacctcttctttgcagtgtatctaaaagagtacgaagatagcacaaccggcgagacaatcaagaaacgcgtatttgatacaatcccactcaagaccgtaattgatcgcctcaagaacgggcagacccccgcccccgaagaaaaagacggcgccaaactcttgttcgtgctcagcccaaacgacctagtctacctcccaaccgaagacgtagtaaagaacggcaccatcaacagacccctcgacaagcgcaggatatacaaaatggtatcatgcacaggcacggagtgctactacatcccattcatcgtcgcaagcccaatcgtggacaaagtagagttcttcagcctaaacaaaataggaagggcaattacaggcgaaatgataaaggaaatctgcataccaataaaggtcgaccgcctaggaaacataacggaagtcaacaatgaaaagatctga

SEQ ID NO: 6931 - RNA, 4623 nt, synthetic construct
  misc_feature 1..4623: note = Cas9 variant
  source 1..4623: mol_type = other RNA
atgaacaagatccttggcctagaccttggcacgaactccatcggttgggccctcgttgggaccgacgaagaagggaacccaatccggatatacaagagtggcagccgaatcatcccaatgtcgcaagacgtactcggaaactttgaccgaggaaacagcatatcgcaaacagctgaaagaacatcctacaggggcgtgcgccgactacgagaacggcacctactccgacgagagcgcctccacagagtgctgcaccttatgggcttcctaccctcacactacgaagaagcaatagggtgggacaaaggggacaacaaaacgttcgcaaaattctactccgacaccgaacccaaactcccgtggagaaagaacgcagaacgagaacacgagttcctattcaacaccccatataacgaaatgctggtcgacttccgtaaaaaccagccacaactctttaaaattaagaaaaacggccaagagtccctaatcccctacgactggacgatttactacctacgaaagaaagcgctcagcaaacccatctccaaaaaggaactcgcatggataatacttaacttcaaccagaaaagaggctactaccaactaagaggagaagaagaagaagagaatagcaacaagctgatagagtaccatgccctaacggtagtaaaggtaatcgcggacgaaccccaaaaagggaagtcggacatctggtacaatgctgaactggaaaatggatgggtatatagacgctcctccaaaaccccactattcgactgggaatcgaaggtgaaggagttcgtcgtgaccactgacctgaacgctgacggatccctgaaagtggacaaagaagggggcgtaaagagatcgttccgcgtgccgagcgaggacgactggatgctagtcaagaagaagacggaatcagacatagaaaagagtgacaaaaccgtaggatgctatatatacgataccatactacaaaacccatcccagaaaatccgcggaaaactcgtacggacaatcgagcgaaaattctataagaaagaacttaccgaaatactaaacaagcaaaaggagttccacagcgaactacaaaacaaagaactataccaagaatgcataaaagaactctacccccacaacgaagcgcactacgactcactactcgtaaaagactacacagacctcttcgttaacgacataatattctaccagagacccctcaaatcgaagaaatccctcatcagcaattgcccttatgaataccgggtgtaccgcaacgacagcggaatagtagagcgcgtacctatcaagtgcatagccaaatcccacccgctataccaggagttcagattatggcaattcatccacaacctccgaatctatgagcgccaacgtgaagtgaacggcaaaccagaaacggacgtcgacataacggccgagttcatcccaacaaccgaagacagggtaaaactcttcgactggctaaacaacaagaaggaaataaagcaagacacgctgctgcaaagctacttcaagataaagaagaagaaaggcgacgacaaattcccttaccgatggaactacgtcgaagataaagaatacccgtgcaacgagacgcgcgcgctcatattaagtcgactgaccaaactgaacctatcagaagactttcttacgaaagaaatggaactggcactctggcacatactatacagcgtggaagacaaagaagagatcaagaaagcattcaaatcgttcgcccaaaaacacaatctagacgactcattcgtagaccagttcatcaaattcccgcccttcaagaaagactacgggtcatacagcgcgaaagcaatcaagaaactgctgccacttatgcgcattgggaaatactgggacgaaaaagccatctccgggaacacgcgaagtcgcatactcagcattaacgaacgactagaggacatgcgctcgtccggaaagaaaatcgaggacgtcagcgacgacgacatccccaaacaggtgctcaaatccttcgacaaagtaaacggagtatactcaggcctcaacacttaccaagcgtgctacgcggtctacgggcgccatagcgaggcctctgaaatcactaaatggaaaacgccccaagacattgacgattacctcaacgaatttaaacaacactcactgcgaaaccctatcgtcgagcaagtgatcacggaaacactcagagtggtacgagacatatggaaaaagtacggcgactttagcgagatccatattgagctaggcagggagatgaaaaacccagcagataaacgagcaaagatgaccacgcagataagtgaaaacgaaaacacgaaccttaggatgaagagtctcctggccgagctcaaaaaccacaacgatgtcgaaaatgttcggccttactcccctagccaacaggaaatcctcaaaatctatgaggagggagtactgaactccgtctcggaaatcccagaggagatcataaaaatcaccaaatccagtcagccaagccaaacggagcttgtgcgctacaaactctggctagaacagaaataccgctcaccgtacactggcgaaataattccgctgggcaaactcttcacctccgcatacgaaatagaacacgtgatcccgcagagccgctacttcgacgacagcctcagcaacaaagtgatttgcgaaagtgaggtaaataaactaaagggcaacctactggggtacgagttcgtgaaaaaccaccacggcgtcaaagtcgaactcaacttcaacaaaacagttgaaatcttttccatcaacgaatacgaagagtttgtaaaaggcaactacggcaagaatcgcggaaaaatgaagaagctgctcctagaggatatccccaagagcttcatagaacgacaattaaatgacacccgttacatctccaaggtcgttaaagggctcctatcaaacatagtaagggaagacggcgagcaagaggcaacctcaaaacacgtcatcccatgcacaggcggagtcacaacaatcctaaaacaagactggggcctcaacgatgtctggaacaaaatcgtaaccccgcgattcgagaggatgaacgagctaaccaacacaagcctattcggccaatgggaaaacaaagaggggaaaagaatattccgcacggaggtgccactcgagctacaaaaaggttttaacaagaaacgcatagaccaccgacaccatgccatggatgcaatcgtaattgcgtgcgctacacgatcccacgtaacgtacctaaacaacgaaagctcaaaggctaatgcaaaagagattcgtgatggcctcaaacataaattgtgcttcaaaagcaaaaccgacgagacgggcaattacaagtggcagttccataagccgtgggacacattcacccaggacgtccaagatacactcgagaacatagtcatctccttcaagcaaaacctccgcgtcatcaacaaaaccaccaaccgctaccaaaagtacgaagaagaaaagaaaatactaaaatcgcaagaaaaaggtgactcgtgggccataagaaaacctctacacaaagatacagtctttgcaaaagtctccctacagaaaataaaatgcgtaaaactcgcgatggcactcaaggactggaaaaacatcgtcgacaaacaactgaagaaagaaatccgccgtctaatcctctcctacgggaaattcgacgcagaaatcctcaacaaatacttcaaagacaggaagtacatatttaaagacgttgacattagcaaagtcgacgtgtactactttgagaccgaatacgtagcaacccgaaagaatctcgacacctcgttcgaccggaaaagcatcgagtccatcacggatacaggaatacagaaaatactcctgaaccacctaggcgtcaaaaacaacaacccagaactcgccttctcagcagaggggatagatgaaatgaaccaacggatcgtggagctgaatggcggcaaacaacaccaacccatctacaaagtcagaatgtacgaaccactaggaaataagttccaggtaggcagaatcggaaataaaaaggacaaatatgtggaagccgcacccggcacgaacctcttctacgcgatttaccaatccgaggataaaaagcgaatatacgacaccatacccctaaacatcatcatcgagcgccaaaagaaagaactcttccccgtacccgaaaacaaagaagacaaagacaacctctacaagttgctattctggctgtccccgaacgacatggtatacctgcccacggagaaggaatgggccaaccccgacctcttcaactttaataacatgaccaagaatcagcgcaagaaactctataaattcatcgatggctcaggtacgaccgcgaacttcatccctaacaccgtcgccaacattatcttctctatacccaagaaagactcagggaaatactcaatgggtaaccgcatagtacaaaacgagttcggcatcggaagcccccaatccaagaatcagaaagccttcaccggcgagatgatcaaggagcggtgctggaagttgaagatcaaccggctcggggacatcatcgaatgcataaaatga

SEQ ID NO: 6932 - RNA, 4629 nt, synthetic construct
  misc_feature 1..4629: note = Cas9 variant
  source 1..4629: mol_type = other RNA
atggaaaagcgcatactcgggctagatctaggcaccaacagcatcggatgggccctagtaaagggggaaaggcacgagaacgacaacgaaactatcctgagctacatagaagccgctggctcacgcatcctgccactcgacgccgcagcacagggagacttcgaaaaaggcaaccccgcgaagacccaaacctctgaaaggacacgcatgcggggcatgagacacctcctagagaggagcctacttcgaagagagaggctgcaccgcgtactcgacataatggacttcctgccccctcactacagccagagcctgacccgctacggcaaattcaaggcagacacagagtgcaaactagcatggagaaaaaccgagacagggcactacgaatttctattccaggatagctttcaagaaatgctgcaagacttccaaaatcatggaaaactagaggaaaataaaaagatcccgtacgactggacaatatactaccttcgtaagaaagccctgacgcagcctgtaagcaaacaggaactagcgtggattttactaaacttcaatcagaaacgaggttactatcaacgtgaagaccaagccgtggacgacaaccaaaaaaagcgggtagagtaccaggccctgaaagttatctccgtggaggacaccggagaaaaaaaaggcaaaaacacttggtacgacgtacgactcgagaacggtcttgtataccattacagcgcaccaataaagccagactggaaaggcgaaaccaaagaattcatcgtaaccaccactattgaccaaaacggcaaacccgaactggacaaagacggcaaacccaagtactcaatgagggcacccaaagaagatgactacaaactattaatggaaaaaacgaaaaaggacatcaccgatagcggcaaatcagtgggtgaatacatctacgacgcattactagtcaacccccaacaaaagatccgtggaggccttgtacgcacgatagagaggtacttctacaaaaaagaactggagaagatcctactgagccaagagcgatttataccggaattgaccgaccgcgaactgtatcgcaggtgcgtagaggagctctaccccagcaacgacgcctaccgccacttgatagagtcacgcgacatgcggtacctcctcgtggaagacatcttgttctaccaacggccattgaaaagcaaaaagagcttgatcgacgactgcccctatgaatcacgatcgtacgtcgaccgggagacaggagaaatcaagagctcgccagtcaagtgcatagcgcagtcacaccctctcttccaagagttcagactgtggcaattcatacataacctccgcatctaccagaacgagcgcagcgttgaaggaaagctacagctcgacgtggacgtcaccgaagaagtgttacccaccccagaaagcaaagcagcactctttcggtttcttaacgaccgggaaaatgtcacacaggaaatcttactgaaagaggtattcaaagggcgaaaattaagcgtaaaagactgcccatatcgttggaactacgccggagaaggaaaaaagtacccatgcaacgagaccagacatcttatgctcaaactcctgaaaaaagcaggaatcgacactgcattcctcaccccagagaaagaacaggccctgtggcacatcatgtacagcgtagaagacaaggatcaatacgaaaaagcactttcaacgttcgcacgaaaaaacgatctgcccgacggcttcaaagaacaattcaaaaaagcaccaaccttcaaaaaggattacggagcctattccttgcgagcaatcaaaaagctgttgcctctcatgcgcgtgggagaatattggtcagcggactgcatcgacagcgaaacgaaagaacggatcagtcaaatcatccggggagaaatggacgaaaaggtatcacaaagaatgacaaagtcaagagactcttttacggacatctcccaattccaaggcctcccagtatggcaggcctgttatgtggtgtacggccgccacagcgaggcaacggaaatccagaggtgggagaaaccggaggacatagacgtatatctaaaggcgttcaaacaacactcgctgcggaaccccatcgtagagcaggtggtactagaaacccttcgggtcgtacgcgacatatggaagacctatggaaaggtagacgaaatacacatagagatgggacgggacatgaagaacaccgcagaagaaagaaaacgcatatttaaccgcaaccagcaaaatgagaacgacaacctgcgcataaaagcgctcctcacagagttcatgaacccagattttgagatagagggagtcaggccatacagcccgagccaacaagaggcactccgcatttacgaggacggcgcatggtccggcttagacgaagagaaagaagacaaaaaagagctcgaagcaattcgcgagatcctgggcaaattcagtcaatcggacaaagccaaaagaccgacgcacagcgaagtcctaagatataaagcttggctggaacaaaggtatagcagtccatacacaggggaagccataccactggccaagctcttcacgccagcgtacgaaatcgaacacgttataccccaatcccggttctttgacgacagcttcagcaataaagtagtctgcgaagccgaggtcaataaactgaaagacagaatgctcggctacgaattcataaaggcgcaccaaggtgaagtagtgtcgctatcaggaacaggccggtgcgcacgcatcctaagcccggaagagtacgagcagcgagtaaccgactgctacaaacacaacaccgcaaagatgaagaagctacttatggaggagataccagacgactttatccaaagacaaatgaacgacagtcggtacatctccaaactggtaaaatcactgctctcgaacatggtcagggaagaaggagagcgagaggccatctcaaaacacgtaatcacatgcaacggaacgatcacggaccgactaaaaaaagactggggggtgaacgacgtttggaatcacatcatactcccccgttttcagagaatgaaagacctcactggaagaaacgacttcgttgcagtcaattcacaaggacatgagatcccctccgtcccaccggaactacaaaagggattcaaaaaaaaacgcatagaccaccgacaccacgcgatggacgcaatcgtcatcgcttgtacaaccagaaaccacgtaaacctactaaacaacgaagctgccatgtcggaaaacaaagccaataggatagccctctcgcgcaagctaagacgctacgaaaactgcgcgatctacaagggcggcgagacaaagaacatatcagtggcaaaagaattccttaaaccctgggcgaccttccccgcagatgtcgagcgggccctcggcgacatagtagtcagcttcaagcaaaacctgcgggtaataaacaaggccaccaaccactacgagcattacaaggacggcaaaaaagttaaagttccacagaaaaaaggggacatgtgggtcgtacgaaagcccctgcacaaagacacggtgtatgcactcgtaaatctgcgcaacgtaaagaccgttggcctgaaggacgccatactaatgccagatcgaatagcgaataaagacctcaagaaaaaagtaaaggaactcctggcccaaggcgatgacctaaaaaagatcaaaaaatatttcgagacggagaaagacacatggcaggacgtcgacgtcaagaagatcgaagtctactatttttcagaagaaacagcaaaccactactacgcaacgcgcaaaccatttgacgccaacgtgaagatcgattcagtgacagacaccggaatacaaaagatattgaggagacacttggaagagaacggtaacaaagcagacgtagcattctcgcccgaaggaatcgcacgaatgaacgagaacatctttcggttaaacggaaacaaacaccaccaacccatatataaggtacgagtatatgagaaggccaataaatacccggtaggccagacaggcaacaaagcaagtaaatttgtcgaagcggccaaaggaacaaatctatacctcgccgtctacgaatcagaagtagtcgacaaaaaaaccgcagaaatcagtaaaaagcgcagctacgtaatcgtacctctccgagacgccgtagcgagacaaaagcaaggggtccccgtcgcgcccgaaagaaacgaggagggaggcaagctactgttcgtgctaagccccaaagactttgtctacgtgccaactgaagaggaacggagcaaaggcgaagtgctgctcccactagacaaaaacaggatctacataatgatggacgcatcggatggaatagtaaacttcctcccctacagcgtcgccaacttgatctacgcgctcccaaaagaccaagcttccgggttctgcaccgacggcaggatgatccagaacgaattcggactagggtctcctaaaagcaaaaacgaacgagcactaacaggcgagatgatcaaggaaatctgccttcccgttaaagtcgatcgactcggccgcatcacagagatcaacggaaacaaagtctga

SEQ ID NO: 6933 - RNA, 4644 nt, synthetic construct
  misc_feature 1..4644: note = Cas9 variant
  source 1..4644: mol_type = other RNA
atgaagaagatactcggcctagacctgggaaccaactccataggctgggctttgacgaacaacgatttcgacaacaaattagggtctatagaaggccttggctcgcgaatcatccccatgagccaggacgtcctgggcaaattcgactcgggagtctccatctcgcaaacagcagaacggacgaaatatcggggcacacggcgactcgtccaacgattcctcttacggcgcgagcgtctccacagaatactcaacatactcgacttcctcccacgacactactcggaagcgatagacttcgataagaaattcgggcagtttaagcccgaacgtgaagaaaaactttcattctacaaaaacgaatccggcaaaaaccagttcttgttcctagaatcgcaccaagagatgttctccgagttcaagctcacacaccccgacctaaaacaagtaccatacgactggacgatctattatctccgcaagaaagccctcacccagaaaatcagtaaagaagaactagcctggatcatcctaaacttcaatcaaaaacgaggatactaccaactccgaggcgaagaagaggaagtaaacaaaaacaaactagaagagttccacaccctcgtaatcgtagacgtcatcgaacgtgaaaaaggcaaatcaggagtctggtacaacgtaattctggaaaacggctggatctacaaacgagagtcaaagatagccctgtttgactggatcggaaaacaaaagaactttatcgtaaccacggaactcaatgacgacggaaccatcaagctcaacaaagacaacgaggagaaacgatcattcagatcaccgaaagaggacgactggggcctacggaaaatccgaacagaacaaaccataaaccaatccgaaaaatccgtcggcagcttcatctacgacgagctgctaaagaaaccaaaccagaagataaaaggagaactggtgcggaccatcgagcgaaagttctacaaggacgaactatcgaagatcttaaaagcccaaatcacattccactacgaaatccttggagatcgaaacatatacaagaagtgcatcgacgaactataccgccacaacgactcccacaaaaacaatattaaagataagggattcgactacctgttccttgatgacatcatcttctaccaacgaccactcaagtccaagacgtctctaataagcgactgctcactcgagttcgtgccgattaaagacaaaaaggggatcctggtgaaagatagcaatggtaaacaagtggtcaaacccttgaaatgtatagcgaaatcaaatcccatcttccaggaatttaggctactccaattcgttaaaaacctcaaaatatacaaaaaggaaatcataaacgagatcgacgtgaccaacgactaccttaaaacagaagaggatctggttgaactcttcgactggcttaacgacaaagcagaaatctcccaaaagcagttcctcgcataccctaaattcaaactcaaagaagacaagtaccgatggaacttcgtcgaggacaagatttacccatgcaacgaaacacgtaaccaattcctcaacgccattgcaaagatcgatgtcaacaagtcgttctttgacgcgaaaaacacccaggacctgtggcatatcctatactcagtgaccgacaagacggaactattctccataaacactgaaacgggcatacaatccggcgcactctcaaccttcgcaaaacgccataacctatccaacgagttcgtctctaacttctctaagataaaaccctacaacaaagactacgggtcctactccgaaaaggcgatcaaaaagctactgccgctaatgagattcggtagcaactggaataaaaacaacatcgatgctaaaaccctagcacgaatcgacaagctacaaaccggagagttcgacgaaacaatgcgtacccgggtacgcgaaaaagcgatccacctgagtaaaatcaccgactttcaagggctgccgctatggcttgcctcctacatcatctacgatcgacactcggaggcttctaacatctctaaatggaagacaccagaagacatcgcttggtttctcaacccgaaaaataaatctggcttcaaacaacacagcctcaggaatccaattgtggaacaggtaatcaccgagaccctccgcgtagttaaagacatctggcagcactacggcgaaggaaaggaaaacttcttcaacgagatccacattgaacttggccgggagatgaaaaataacgcgaacgaccggaagcggattacggagacaataaaccagaacgagaacacaaacctacggatcaaagcaatactaacggaattaaagaacgacggcatcaacgacgtccgcccatacagcccctcccaacaggaaatactcaagatttacgaggaaggtgtttacaacagcgaaatcagaaaggaaaaactcgaagatatagataagataagaaagaacgccaaacccacgccaagcgaaataatcaaatacaaactgtggctagaacaaggctatatctccccatacacaggcaagctgatacccctgagtgatctgttcacaaccaagtatcagatcgaacacataatcccgcaatcccgattattcgatgactcactatccaacaaggttatctgcgagtcggaagtaaacgacttgaaggggaacaacaccgccctggagttcatactcaagaatgaagggagaatcgtcctcctgacagggggcaaaaccgtcaagatctttacaaaggaggcctacaaccaacatataacgtcctactacatcaaaaacaaaagtaagcagaaaagactactaacagaagagatacccgaaaaatttatagaccgccaactcaatgacacaaagtacatctcgaaaatagtgaaaaatctactcagtaaaatagtacgggaggaagacgaacaagaagtaacatcgaaacacatcgtatcgctgaacggcagcataacctcacgcatgaaacaagattggggtctaaacgatgtctggaacaaaatcgtgagtccccgcttcgagaggctaaacgcgatcacaaacagcaacgatttcggcaaactcgaactaaagaaagacgagttcggaaacgcaggcaaacaagtcttccaaaccacagtgcctgacgacattgcgaaagggttctccaagaaacggatcgaccaccgccaccacgcactagatgcgctcgtaatagcatgcataaacagaacgcacatcaattacctcaataacttaaacgccaaagacgaaaacgataagaccatcaagcacgaactccgaaacaaactttgcttcaagactaaaccagacagcaacggtaacagcaagtgggagttccacaaaccgtgggaaaacttcacgaaaaaggtagaagacgagttgaaccaaaccatcatatcgttcaaacaaaacacacgtgtcataaacaaaacggtcaacaagtaccaggtctggaaagaggaagacggcgccatgaagaaagtgaccgtgaaacagacgaaaggcgacaactgggcaatccgcaaacccatccacgcggagaccgtctcgggcaaagtcttcctgaaacgcatcaaacagtcccacattaccatagcaaacgcgatcgagcaaatagagctcatagtggacaaagaagtacggaaacaactcaaagccaagatcaaacagtacccaaacaacaaagaagggttcaagaaacatctcaaagcgttcccgataatgatcaatggcaaagccatcgacaaagtccagatatacgaaacgatagaggcaaccgccacgcgcgagcggaataacctagacatcaccttcgacgaaaagaaaatagagaagataacagacacaggcatccagaaaatactcttgaaccatctgaagcaggagatataccaaaatgccatcgatgaatccggaaagaaaatagcgccacacgaggtagcgttctcggaaatcgggatcgacgagctcaacaaaaacataaaagtcctcaacaatggtaaaaaccaccaacccataaagaaagtacgtatcttcgaagaaagcaaacgattctcactcggccaatccggatcgaagaccgacaaatacgtcgagacggcgaaaggcacaaacctattctacgccatatacgaaggcaaaaagggcaatagaaactacaaaacgatacccctcaatgaagtcatcgagcgacaaaagcaggggctcaattccgcgctggtcacagacgaaaacgaaaaccggctccttttcacgctctcccccaacgacctcgtatacattccaacaaacgaagaaaagaaaaacctcaccaccataaatttcgacaaactttcacgcgagcaaaccgaacgcatatacaaattcgtgagctgtacctccggagagggacacttcgtcagcaacaattattcgaaagaaatcatatcaaacgaaaacggatccaacaacaaaaacgaacgcatgctcgagttcaataatagcaacaccatctacgacgaaaaggagaaaccagtaatgataaaatccgtctgctggaagttagaggtcgaccgcctcggcaaaataaaacgaataatcaggtga

SEQ ID NO: 6934 - RNA, 4677 nt, synthetic construct
  misc_feature 1..4677: note = Cas9 variant
  source 1..4677: mol_type = other RNA
atgaagaagatcctagggctcgacctaggcaccaattcaattggatgggcactcgtcaacgtggataagaacggcaacccattcggaatcgaaggcctgggatcccgaatcatacccatggaccaggccacgctaagcgacttcgagaagggcaattcaaaaagccagaccgcggaacgcacgatgttccgcggcgcacgacggctgcgcgaaaggaagcacctccgcagagaacgcctacaccggatccttaacgaactcaactttctacccattcattaccggtcctgcattgacttcgtacacagattagggaagttcaaagcgaaccacgaaccaaaaatagcctggcgcagtaacgaccaagacaaaatggagttcatattccaaaactccttcctggaaatgatgagcgacttcaccaagcgccagccggaattagtaaaggaaggcaaaaagatcccatacgattggacaatctacttcttaaggaagaaagcgctgggccagcgcatagagaaagaggaactagcatggctcctgctccacttcaatcaaaaacgaggctactaccagctccgcggcgaagatgaaatagacgcaacacgatcagccaagacgcgcaagtactttgaccgcaaaattatcaagtcaatcatcgatacaggcgaggaatacaagggcctaaaagtactaatcgtcgagctcgataatggcaaccaaggtaaaatctttaaacaagaagtcccagactgggtaggacaggagaaaaacatcatagctaccgtagaccttgacaaagacgggaaagatcggtttgacaaaggtgtactaagtcaacgattcagcatccctagcgactccgaatgggaaacagaatggaaactgatcaaactaaagacagaggaagacctagaggcaagccagaaaaccgtgggcacttacatatacgacagcctcctcaaaaacccaaaccaaaagatcaagggaaagctggtacggacaatcgaacgcaagtactacagagacgaacttcgggcaatactcaacaaacaacgcgagttccacccagaactcaacgacaaaaagttataccagcactgcattttctccctctacccacaaaacgaagccttccgaaattccatagcaaacaaagacttcacttatctattccttgaagacatcatcttctatcagagacccctaaaatcgaagaaatccaccatcaacaactgcgcctacgaagtccgacgctacatggacaaagaaacaaaagaactgaaagaggtccccctgaaatgcatcgcaaaaagccacccgatcttccaagagttccgcctgtggcagttcatctccaacctccggatttataagaaggacattacggacatagacgtgacaaacgatttcctccactcccaagatgattacgccaacctcttcgaatggctgaacaacaagaacgaaatagatcagaaggcctttctgaagtaccccgccttcggattcaagaaggacgctgtcaactaccgatggaactacgttgaagacaagtcttacccctgcaacaagacaaggtcagccatcctgtctaagctcgacaaacacgaacaagaatttctaacgaaagagctagagctaaaaatctggcagttattatacagcgtaaactcgaaagaagaaatcgacaaagcccttaacgtgaactccccgaaaatcaataataaaatctcaatcgaccacactggcattctccatgaactcaaatcatcctccctcagcgacatatccatccaaagactcaaagcaatcaacttcgaggaaaaagactacgggagctacagttataaagccatcaagaagctgctcgccctgatgcggcagggcaagtacttcgacaacacggcaattaccgacgccaccaaagcacgcatcaactctatattcgaccgtttggagtccatctcattcgaccctgaacgcataaactccatcagcgatgacgacattccgaaacagatcctcaaatcattcatcaagctgaaccgaacctacggcgggttcaacacttaccaggcttgctacgcagtctacggtcggcactccgaagcgaaggaaatagcgaaatgggaaaaacccgaggacatagaccaatacctcgccaagttcaaacaacactccctacgaaaccccatcgttgaacaaataattacagaaacactcagagtcgtacgcgacatctggaagaaacacgcctacaaaaccataaacaaagacaaccaagggaacaactgcgagtccgaatccgagctcaccgaaatacacatcgagttaggtagagacatgaagaacaacaaaagcgaacgtctccgaattagtcgcatcaattcagaaaacgaaaacaccaacctccggatacggaaacttcttatcgagttcaatgacccggagttcggggttgaaaatgtacggccccactccccctcacagcaggaaatcttgcgcatctacgaagacggggtcctaaaatcaggcgtagaaatccccgaatacgttgataacatcataaagaaattcaaagaaacggacgtcaagaagcagccgagtaaatcagaagtcctacgctacaaactctggctggagcagaaatatcgctcaccgtacacaaacgaagtaattcccctaggaaaactgttcacgaacgactaccagatcgagcacataatcccccagtctcgatacttcgatgactctttctccaacaaggtgatctgcgaggcggaagtgaaccagttaaaggagaacgaacttggttgcgaatttatcatgaacaacggtggcagaatagtagaactttcattcggcaaaacagtccgtattctcgacttcgaggcgtacgagcagttcgtacagcaaaactacgcgggaaaccgacccaaactccgaaacctcttgatgaccgaaatcccgaacgacttcatcgatcgacaacttaacgactcgaggtacatatcgaaggtcgtcaaaggcctcctctccaacatagtcagagaagacggcgaggcagaatcgacctcaaagaacctcatcagctgcacaggcggcgtcacagctcgcttgaagatggactggggcctaaacgacgtctggaacaatctcatatatcctcgattcgagaggctcaacgaactgacgaacagtaaccaatttggatactgggacaagaaagacgggaaaaacgtcttccaaacgcaagtaccaatggacatacaaaaaggctttaacaagaaacgtatcgaccatcgacaccacgccctagatgcactcgtaatcgcttgcgcaacccggagccacatcaactacctcaacaacgaatccgccaaatctaattccaaagaaagccgctacgacttgcgcagaaagctcagacgactagaagtgatccagaaagaatacacaataaacggccgtaaagaaatccgtaacatcgaagtcgctaaagagttctacaagccctggaactcattcacccaggacgcccaatccgcactcgaaaatatcgtggtcagcttcaaacagaacctaagagtaataaacaaaaccacgaactacttcctccgctttaacaaagaaggcaaaaagatattcgaaacccaaaccagcggatctaattgggcgatccggaaacccctgcacaaggacaccgcatttggactggtgaacctcaagcgaaccaaaacagtgtccctagcgaacgcaatcctggactacgaccaaatagtcaatcgaaaactatggactaaaataaaagagttaatctcgatcggatatgacaacaaacgcatcctaaaatacttcacagatgacaaagagaactggaacgaaatcatatcctcgggcatcgaggtcttttactacaccgacaacttcgaaaagcaggtcgcgacacgaaagccactggacacctcgttcaccgaaagcaaaatcatcaactccatcaccgatttaggcattcataaaatactgctcgcccatctccgagccaacgaaggaaacccgaacatcgccttctcacccgaggggatagaaacaatgaaccgccacatatgtgagctcaacggaggcaaattccaccaccccatatataaagtccgcgtgcacgagcccctaggatataaattcaaagtgggagataagggcaaccgcagcacgaaatatgtggaggcggcgaaaggaaccaacctcttcttcggaatctacatcaacagtcagggtatcagaagttacgagacgatccccctcaacgtggcgatcgaacgacagaaacaagggctctcgcccgtaccggataacaatgagctcggcgagcgcttactcttctggctcagcccaaacgacttagtatacctgccaacgagcgacgaagtcgaatccggaatctgctgcaacaaattagggatagatcgcatatataagatggtctcctgcacgggatacgtcggggacttcatacccgcgcacattgccaacccaatcattcagaccttagaactggggagcaacaacaaagctcaacgggcctggacgggggaaatgattaaagagatatgcatacccgtgaaggtagaccggatgggaaacatcgtcgaaatcttcaaccgaaacaaaaactga

SEQ ID NO: 6935 - RNA, 4695 nt, synthetic construct
  misc_feature 1..4695: note = Cas9 variant
  source 1..4695: mol_type = other RNA
atggccaagatactcggactcgatctgggaacaaactccataggctgggccatcgtagacgacaagaacagtaaaatcctcgacacgggcgtccgcatattccccgaaggcgtcgtcgccaaaacgatcggctcaggagacaaagaggagtcgaagaatgcaaaacgccgcgaatcacgccaaacccgaaggggattctaccgaaagcgacttagaaaaataaagttactccggacactcattaacttcaagatgtgcccactcgaacacttcgagctggacgtctggtcaaaatgggacaagattaaaaagaaagaaggccgcatggcaccagagctctttctaccggaaaacagcgcgtacaacctctggctcaagcaaaacccatacatcctgcgcgacaaagcactcagtaaggacttaacgctgacggagttcggccgggtcctctaccatctcatccaacgacgcggcttcttatcgaaccgaaaagggaaggacgacggcaaaatctacggaggaaaagaaggcatagtcggaatagacaaaacgaatgaacaaataaagaactcaacactcgggaaatttctcttcaaaatactccccaaggaaggcgaacccttcaaaatcatcgaagacgagttaggaaatgagctccgcgtccgctcacgctacacccttcgagacatgtacatagcggagttcgaagcgatctggaaccgccaggccaagcatctgggcctagacaatatctactacagcaacgtgaagaatgtactcctcaaaggatcgctgaaaaacaagaaaaatgaaaggaaaataaatcatctaaagaaaatcaaagggaacggcaacatcgaaattatcaccctgaataataacttaagcaaaaacgaaaagcccaaatatctcctaaaaatcgcaacgaagctcccactaaaggagttccttgccgggcgaatcgaaaaagacgaagacggcaaaataaagttcaaatctaatgaatccgtgctcttttggcaacgacccctcaggagccagaagaaactcctcgccaaatgtcgatttgaacctgatctgaaggacgacaacggaaaattcatacagaaaggcaaaacaccctgccacctttcccatcctctatacgaagaataccgcgcgtaccaatacgtcaataacatagagtacggcaagaagcaacgattagaggagtcgcagagaaaacaagtcatcgatctcatcaactccaaagatggcaacttcaaattcagcgaaataaagaagaaactaaaactaagctacgagactttcaactacagtgacgactcgtcggtcaacggaaactatatgatcaaaaatctaaacagtatattcccaaaagagatacttgaaaaagagttcgtggtcaacgtaaacaaagaagacatcatcgaatatggttacgaacggatatggcacctcttccacttctgcgaagacaacgacgtactgatcaagaaactacaagacaacttcgacctatcagagaatgacatagagaaaatctctaagattaaccttaaggaaggctactccaacgtctcattgaaggcgataaagaacatcctcccatacctcaaagaaggaaaacttctaagcgacgcagtaatactagggggagtacgaaacgtcttcggtaagaagtggcacgagttcatagatttccacgaaaagatagaaaaggacatactgtacatcaaccaccagaagtcaaacaaagaaggcgaggctatagagaaaattaaaaagtacctgatagactacaaatttggctttacggaaaacgacaaccgattcaaaaagctgtaccaccactctcaagacgtagtagaagtcaagctgcaaaagaaaatcgggcccgtggaggacctccgcaacccgatcgttcagcagggggtaaacgaggtgcgaagacttgttaacgagctcctcgacgtacacggaaaattcgaccaagtacgcgtagaactaggaagggacctgaaaaacaataaaagcaaacgcgaagagatcggttacaaaatacgcgagaatacagcaaagaacgagaaagctaaagagctactcatcgagtacggactgcgccagagtcgagacaacgtgcaaaaagttctactcttccaagaaatgctcgaccggggaacggtcgccgtgtgcccatacacgaacaaaaccataaacatcagcgacgtcctaggcaacgagaacaaaatgcagatcgagcacataataccgaaatcaatcagtctcgacgacagcttcgcaaacaaaaccctgtgtgactcaaagttcaacgggctgaaaggcgagcgcaccccctacgagttctaccaaatcaacaacgacgcaaacttgtggggcggttccaaaagctgggaagaaatcgaacggcggacattccgcatcctcccatacagtaaagccaaacgcttcacctcgaagaccaagtttgagacgaatgacttcatccagaggcagctcaatgacaccagatacatatccaagaaaacgaaagagatcctgtcgcagatatgtgaggacgtacgtgtcatgcctggatcactcaccgcagaactcagaaaactgtggggactaaacaacatcctccacccggccttcgtcctagacctccccgccctacacatcgacgccaacaagcacatcccccactacgtagtactcgacgaggacaacgttcccatcctgtcgcaacggatctacaacgataaaccgatattaaaggccaaccagacatcaataaccggattcgtagacaacgaaatattcaagagcaaagaaaaatacgtaaaattcgaggtgaaagcacccaacctctcgaacggcgaatattgggccaagctactcctctccaacccgaaatcgatcgtccgcgtcttcaaggaaaaaccgaagtctacggaaaacgaaatagtcgtacgaggcaaaatagagaaagaaaagttcaaacacgaaggcctctcaggcattaacgccgagggcaaagaaaacgggacttactgggccaagctaagcatagtggacaagaaattcaagaaacccaagaaagacgaccagccaaagaaaaatggcaaacagatactcctatttggagccgtgaaagagggcgtctttagcagctacatgtatgaatgtgacgccgatctcgaagatggcaaatactggttaatcctggacatcgatttcgaaaatgtggagttcgaaaaagccctaaacgaacggccagaagtcctagaaaaccaaatccttatccaaggaatcacaaacgacgaaaacgtcttcgtgagcgacatggactgtcagcaccaattcctgatgaacgagggcaagggaaaatactacgtcctattcgacatcatctcagaggtaaacgagttctacccaatcaagacaaaatcgcccgagttggaaaacggtcagtccctaaccgaagggaccatttgggtggataagtacacgggagagataaagttcgacccaaagaaaaacagagaagaccaccgacatcacgcaattgacgcactcgtaatcgcgctaaccaaagaaacctattttcaacaactaagcaggaggaatgcatcctcagaaaacaagaaaagaggtaacgaatacgaaaaagagcagcttgacttcgctgagccatggaaagagttccacgtagacgcccaaaaatcaatcaacagcatactcatctctcacaaacagaacaaaaacatattgacaaaaatcacaaagaaaataaccaaaaacggcaaaacctacaagtcagaagggatgagcgtacgcggtcagttacacgacaaaacctactacgggcacaacaagaactgcaaagcggacgaatatgtctaccgggtcgacatcaataacctctcattttcgcaactgacaaacatcatcgacttaaacctgaaggccgtaatagtagaaggcgtaatcaagaaattcgaagagtccgagaaactcctgttcaagaaaatgaactccaaagtacaaaacctagataaaagcaaagtcaagaaaatcaaagccaaagtcgacaaaatactcaaggaaacgtccttcttcatgcccaacgagggtaaacgctacatccgcctaaacatcatagaacccgccaactttgaacgcatgcctgtgcctatcaagaaagtccggataaggaaagtgctccgcaacgcggagaaactgaacaacgaaattaaacaatttgtagacccccagaacaaccaccacgtcctcatctacaaagacgagaacggaaacctgaaggaggaggtcgtaaccttttggaccgtggtagagcggaagcgcaccggcgaacccgtctacaagctgccatccgacgggaagaagatagtaaccaccttacagataaacgacatgttcctccttggattgaacgaagacgaaatcaactgggagaaccctaactacaaccacctcaaagaacacctctaccgcgtgcagaagttcacttccggtgacttttactttcgcatcgccaaaacctcatcaatccaaaatggcgaagaaaagcaacaaatcaactcgttcggcctgggcaagaacggctggctcacccacaaccctataaaggtcaaaatctcggtctcagggaaaattctcaaagtatga

SEQ ID NO: 6936 - RNA, 4713 nt, synthetic construct
  misc_feature 1..4713: note = Cas9 variant
  source 1..4713: mol_type = other RNA
atggaaaacagcaacaattcctcaaagaagtactacctcggcctcgacatggggacagatagctgcggatggtgcgtcaccgacgataaatacaacatcatccgatcgcacaagaaaatatacggcccagatggcaaactggtaaagcgcgagggttgccatctatggggcagtcgcctgtttcgacccgccaacaccgcaaaaagccgccgtcttaacaggacggcacgacgccgactggcgcgacgccgacgacggattatcctcctgcgggagctatttcaaccagagattgacaaggtggatccaaacttcttccgacgactcgatcaaagcaacctgtggaatgaggacaaagacaaggaactacaaatggaacacaacttcctattcaacgacaaagacctgacagacaaagaatactacaaggactttcccaccatctaccacctacgcaaagctatggtcaacgggctcaccattaacggctactactacgatcccaagaagcaattcgacatacgcgaggtatatctcgtactggcccacatgatcaaatacagaggaaacttcttaatggaaggagacgtaaaggactcagtcgtggacccaacctatctgaagcagtgcttcgacaacatcgacgtcatactgatctccctcaacaacggagaagacgatgaaaatgaggacgacaaaatcgacccatcagaatgttgttttaacgtcgacgagaagaaagcccgaaaacttgctaacaacttccaggaaacaaacaaagttagcgacctagaggatgacgagagagacctcttcggtaaattcaactcaaaagacatccgcaaaaagatcctaaagctcatcaatggtggcagcggagtaaagctaaaagacttcctgcctaaggaaatcctagtggcgcacgatggagacgacgagtacggagataagaaaatagacctatcgagcgagacgctggaagacgacataaacggttacagcctcccggaatcatacgtagaaataattttggaagccaagaaaatctatgatttcaaaacgctcgcgtacctgcttcacggaaagagcttactgtgcgacgcgatggtcaatgtctacgaggaacacaaagaacaactcgcagcactaaaacgactctacaagaaatacgccacgaaagagcaatactacttcatgttcagagacagcaggattcttgacggggatgatagcgacgacgaagaggacaaagaagagtccaacaaggaagagtctaaagacaaaaagaaaaaggccagctacgtaagttacatcggctacaccaaaaccaatagcaaagccaaatacacaggcgcgcacatcaccagtgagaagaacatcagcgccctcatcaaacagatcaaagacgacctaaaattcgacgacctaaagagtaaagtagatgacccatcccaacagaacgagttaagcgacgaagacaaactagatatccagtgtatagaagaagccatcgagtccaacactttcctcccccggcaaaacagcagaaacaacggcgccttcccataccagctcaaccttaacgaaatgcgcaccatcattgaaaaccagtcgaaatactacccattcctgaaagacaaagccccctctttccccgacggcaaaacagaggagtacaaaatcgtcagcctgctcaaattcaagatcccctactacatcgggccactcagccagcccaacgactacgtacgcgacgataagcgggacaaccactgggtccagttccgcggcgagaacaatcaagggattataaacccctggaacttcagccaaattgtagacctcgaaggaacggccgacaaattcatctccaacctaactaactactgcacgtacatattcggcgagaacacccttccgaaagagtcactcatcttccaagcctacaaggtgctcaatgacctcaataacctcaaggtcaacggtagcctcatctccaaagaggacaaggactacatcatccaaaatgtctatctcaagaaaaagaaaatcaaaggcaaagacatcgtaaacgcgctcaagaacaaatacaagctcagcgatgaagaccccaccgtaaccacaaaaggctccggcaaaagtataggcgaggacgaagtcgacctcacaatgttcaacagttctctctcgtccttcatcgatatgtcagaccccaacgcattcggtccagagttctataaggacagcaataaattcgaactcgccgaaaaggtcatcgagttaattaccatcgtcgaagacaaagacctactgaaggaacgccttaagaagctgggtctatcagacaatcaggtaaattacctcttcaaacagaaatactctggttgggcccccttatcacggaaactattggacggtataacaattgactgcgtcaatgagaatacgggagaagcgtaccccgtcactatcatagacgtcatgcgcgatacgccgctgaactttatggagatctacgaaacaaaagaaagccaattttccggcttcaaggagaaagtcgcagaactaaacgatgaaaagaaactgtcgcgagacgacctcatagaagaaagctacgccagcccagccatgaaaagatcggtacgccaaaccttcaaggtcatagacgaactcaaaaacacactaaacattgaccacttcgacaggatatttgtagaagcaacgagggcccccggagaggcggggaaaatggttaaaagtcgaaagaaacagctccaagaagcctatgacgcggcaaaagacctcgtggaccaagaatctcgagacgacctccaaaaactgagggacgacctagaaaaacagactgacgaccagcttcgacggaaaaaggtgtacctatacttcatgcagttaggtagatccgtttacagcggggagaaaattgatctaaacgagctcgacaagaattacgacatagatcatataataccacaggccaaattaaaggatgacagcttcaacaacatggtcctggtggaacgagaactgaacaacaagaaacaagacgaatatcccataccctccaccatcatctccgagcatggtcgaaactggatccaaaaactggccaaaatacaggacaagaacaagcggagctatttcatgcccaaggataaagcgaatcggctcctccgcccagaatcaaaacaactaaccagcgacgaactcaacggctttataaaccgccaactcaccctaaccaaccaatccgtaaaagcagtctgcgacatactgaaaatgactgaaaaaggctccgagatagtctactcaaaagccaactttgtctccgactttcgcaaactatgcggcgaactacggcccagctatgacgcctttgtaaaagtgcgggacataaacgacttccaccacgcaaacgacgcctacttaaatatagtggtcggaaacgtatattatgagaaatttaagaacttctacataaacaaccgaatagactacgacaacaacggcaaaaaggacctttcagtcctagccagcaagctattcacgaaaacacaggccgacgacaagacaggaaacatttactgggaagcgcgattccacaatgaaaaggaaactgactcaaatggcaaggagcgtacaataaaagtccgcgacgaaggaactgaaagtacgttcgacaaaatcgaatactatatggagctcaacgacccactcgtcacacaaatgcagtacaccctctcaggcaaacaagggttcttcaaaaagataaccctgaaaaccaaggccaaagacaatgaggacaacagcgacaaactcttcccgctcaaacaatacctacggagcgactcaaacaaagtcatggatgttaacaaatacggcggctacagcgacatgataacgccatacttcatgctggttcaaagcgaaggcaagaagggaaagcacatctactcgcttgaatccattccgacaatatacctaaaatcgttcaagaaaaaggaagaagacattatcaattacctgtcttgtaaaaacaagctaaagaaccccgtagtgatctctgacaagctactgatgagaacgattgtaaaaataccatacttcaagaacgactccaacctaagtctagtcaaactaggcacaagcggacgaaccggcaacaacataatctacataaaccttagcgaactcatattaccaatcgagtggaaaaactattacagaaaaatatcaaacttgctgggtaccaacgtctcgtcgactaaacccaaagatctcagcaaattcaccgaacaaatgaaaaacgacccaacatcaaccctagtagacgggagtaacaaagtagaacacgacaaaaacaacaggttcttcagctacctgataaacaacgtcatcaacaaacccatattcgaaggtctccccaagacatcttgcagtttcatcaaacttgaatccaaatacgacgagttctgctcgctaaacacattagaacaggcaaaaataatcgcgacaattatcaagctactcagctgtaaatccgtccaaggctgcaaactctcaaacctctcgggattgccctcgtcactaggcgccctcataagtaacaaagccctcaccgaaggcaccataatctcaaaagaatcaagctgcggactgaaggaaaacatcatcttcgtagtccctaacgactga

SEQ ID NO: 6937 - RNA, 5067 nt, synthetic construct
  misc_feature 1..5067: note = Cas9 variant
  source 1..5067: mol_type = other RNA
atggagttcaagaaagtcctcgggctcgacatcggaacaaacagcatagggtgcgccttgctgagcctccccaaatcaatccaagactatggaaaaggcgggaggcttgaatggctcacaagccgcgtcataccactggacgccgactacatgaaagccttcatcgatgggaaaaacggcctcccccaggttataactccggccgggaaacgccggcagaaacgaggatcacgcagacttaaacatcgctacaaactacgccgttcaagacttatccgggtgttcaagacactaaactggctgccggaagacttccccctagacaatcctaagcgcataaaagaaacaatatcaaccgaaggcaagttttcattcaggatttcggactacgttccgatctcagacgaaagctaccgagagttctaccgcgaatttggatacccagaaaacgaaatcgaacaagtcatcgaagaaataaacttccgccggaaaacgaaaggcaagaacaagaatccaatgatcaaactcctccctgaagactgggtagtttactaccttagaaagaaagcgctcataaagcccactacgaaggaagaactcatccgaataatctacttgttcaaccaacgacggggtttcaaatcttcccgaaaagacctcaccgaaacagcgatactcgactacgacgagttcgccaagcgcctagcagaaaaggaaaagtattcggccgaaaactacgaaaccaaattcgtctcaattaccaaggtcaaggaagtcgtagaactcaaaaccgacggtcgcaagggaaagaaacgattcaaagtgatcctggaagacagcagaatcgaaccctacgaaatcgagcgaaaagaaaaaccggattgggaaggcaaggagtacaccttcctcgtaacacaaaagctggagaaaggcaagtttaaacagaacaaacccgacctgccaaaagaagaagattgggccctgtgcacaaccgccctcgacaacagaatgggatccaagcacccgggcgagttcttctttgatgagctccttaaagcattcaaggaaaaacgtgggtacaaaatccgccaatacccagtgaaccgctggcgctacaagaaagagctcgagttcatctggacaaaacaatgccaactgaacccagagctgaacaatctcaacataaacaaagagattctccgcaagctggcgaccgttctctacccctcacaatccaaattcttcgggcccaaaataaaagagttcgaaaacagcgacgtcctccacatcatatctgaggacatcatatactaccaacgcgacctcaagtctcagaaaagcctcatatccgagtgccgctacgaaaaacgcaagggtattgacggcgaaatctacggtctgaagtgcatccccaagagctccccgctttaccaagagttccgcatctggcaagatatccacaacataaaagttattcgaaaagaaagcgaggtaaacggcaagaagaaaataaacatagatgaaacccaactatacatcaacgaaaacatcaaggagaaattattcgaactattcaactcaaaggactccctatccgaaaaagatatcctggagttgatatccctaaacatcatcaacagtggcattaagatctccaagaaagaggaagaaactacacacaggatcaacctattcgcaaaccgaaaagaactcaaaggcaacgaaacgaaatcacgttatcgaaaagtatttaagaaactaggcttcgacggtgaatacattctgaatcacccaagcaaactcaacagactgtggcactctgactactcgaacgactacgcagacaaagagaaaacggagaaaagcatactatcttcactgggatggaaaaaccgcaatggcaagtgggaaaaatctaagaactacgacgtctttaacctcccactcgaagtcgcgaaagcaatcgcaaacctacctcctctcaagaaagaatatgggtcgtactccgccctagcgatccggaagatgctagtggtaatgcgggacggcaaatactggcaacacccagaccaaatagcaaaagaccaagaaaatacatcactcatgcttttcgataagaacctaatacaactgacaaataaccaacgcaaagtcctgaacaaataccttctcaccctagccgaggtacaaaaacgtagtaccctcatcaaacaaaaactgaacgagatcgagcacaatccgtacaagctcgagctagtaagcgaccaggaccttgaaaagcaagtactgaaatctttcctcgaaaagaagaacgaaagcgactacctcaagggcttgaagacctaccaagcggggtacctcatctacggtaagcactcagagaaagacgtacccatcgtaaacagcccagacgaactaggagaatacataagaaagaaactgccaaacaactccctccgcaatcctattgtcgaacaagtcatccgcgagactatcttcattgtccgtgacgtttggaaaagtttcggaatcatagacgagatccacatcgaacttggccgcgaactcaagaacaacagcgaggaacggaagaagaccagcgaaagccaagaaaagaatttccaggaaaaagagcgcgcgcgcaaactgcttaaggaactgctcaactctagcaacttcgaacactacgacgagaacggcaacaagatcttctcttcctttacagtgaacccaaatcccgactcgccgctcgacattgagaagtttaggatctggaaaaaccaatccggactgaccgacgaggagctcaacaagaaactaaaagatgagaaaatcccaaccgaaatagaggttaagaagtacatactctggctcacccagaaatgccgcagcccatacactggcaaaataattcccttaagcaaactcttcgactcaaacgtctacgaaattgaacatataatcccacgcagcaaaatgaagaacgactccaccaacaaccttgtaatctgtgagctaggcgtcaacaaagccaagggcgaccgcctcgccgcgaacttcatctccgaaagcaacggcaagtgcaagttcggagaagtagaatacaccttgctaaagtacggcgactacctacaatactgcaaagacaccttcaaataccagaaggccaaatacaagaacctccttgccaccgaacccccggaagatttcatagaacgccaaatcaatgacacccgctacataggccgtaaactcgccgagcttcttactcccgtcgttaaggacagcaaaaacattatattcaccatcgggagtatcacaagcgagctcaaaatcacctggggtctgaacggggtctggaaagacatcctgcgtcccagattcaaacgtctagaaagtatcataaacaagaagctgattttccaagacgaggacgaccccaacaagtaccacttcgacctctccatcaacccgcagctcgataaggaaggtctgaaaaggctcgaccatagacaccacgcgctcgacgccacgatcattgccgccaccacccgggaacatgtaaggtacctcaactccctgaacgcagcggacaacgacgaagaaaagagagaatacttcctctcactatgcaatcacaaaatacgcgacttcaagctgccctgggagaacttcaccagcgaggtaaaatcaaaactattatcctgcgttgtatcgtacaaagagagcaaacccatactcagcgatccattcaacaaatacctaaagtgggaatacaaaaacggcaaatggcagaaagtcttcgcgattcagatcaaaaatgacaggtggaaagccgtgcgtcgcagcatgttcaaggaacccataggaaccgtgtggatcaagaaaataaaagaggtcagcctcaaagaagccatcaaaatacaagccatatgggaagaagtcaagaacgatcccgtacggaagaagaaggaaaagtacatatacgacgattacgcacaaaaagtaatagccaagatagtccaggagctgggactgtcatcaagcatgcgcaagcaagacgatgagaaattaaacaagttcataaacgaagccaaagtctcggctggggttaacaagaacctaaacacaaccaacaaaacaatctacaacctcgagggccgcttctacgagaaaatcaaagtcgccgaatacgtgctctataaagcgaaacggatgccactcaacaagaaagaatacatcgagaaactcagcctacagaaaatgttcaacgacctaccaaactttatcctcgagaaatccatcctagacaactaccccgaaatccttaaagagcttgagtcggacaacaaatacataatagagccccacaagaaaaacaaccctgtgaaccggctacttctcgaacacatactagagtaccacaacaacccgaaggaggccttcagcaccgaaggcctggagaagctcaacaagaaagcaattaacaagatcgggaaacccatcaagtacatcacacgactagacggagacataaacgaggaggagatatttaggggcgccgttttcgagaccgacaaaggatcgaacgtctatttcgtcatgtacgagaacaaccaaacgaaggaccgagagttcctcaaacccaacccatcgatctcagtgcttaaagccatagaacacaaaaacaagattgacttctttgcacccaatcgcctcggtttttcccgaattatactatctcccggtgacctagtctatgttccgacaaacgaccagtacgtactgataaaagacaacagcagcaacgaaaccattattaattgggacgacaacgagttcatcagcaacaggatctaccaagtgaaaaagttcacaggcaactcatgttacttcctcaaaaacgacatcgcctccctaatcttatcgtacagtgcatcgaacggcgtaggggagttcggcagccagaacatcagcgaatacagcgtcgatgatcccccgatccggataaaagacgtgtgtatcaaaatacgcgtagaccgactgggcaacgtcagaccgctgtga

SEQ ID NO: 6938 - RNA, 3924 nt, synthetic construct
  misc_feature 1..3924: note = Cpf1 variant
  source 1..3924: mol_type = other RNA
atgacccaattcgaaggattcaccaacctctaccaagtgtcgaaaaccttacgcttcgaactcatcccgcaaggcaaaacactcaaacacatacaagaacaagggttcatagaggaggacaaagcaagaaacgatcactacaaagaactcaaaccgatcatcgaccgaatatacaagacttacgccgaccaatgcctgcaactcgtccaactcgattgggagaacctgtccgcagctatcgactcctatcgcaaagagaaaaccgaagaaacgcgcaacgcacttatagaagaacaagcgacgtaccgaaacgcaatccacgactacttcataggccgcacagacaacctgactgatgcaatcaacaagcgacacgcagaaatctacaaaggactgtttaaggccgaactctttaacggcaaagtcctcaagcaactaggcacagtgacgacgaccgaacacgagaatgccctcctacggtccttcgataaattcactacgtacttctccggcttctacgaaaacagaaagaacgtcttttccgccgaagacatatcgacggctataccccaccgcatagtgcaagacaactttcccaagttcaaagaaaactgccatatcttcacccggcttattacagccgttccgtcactacgcgaacacttcgagaacgttaaaaaggcaatcggcatattcgtatcaacctcaatagaagaggtcttcagcttcccattctacaatcagttactcacacaaacccaaatagacttgtacaaccaacttttgggaggtatatcaagggaagcaggcaccgagaaaatcaaaggactaaacgaagtacttaatttggccatccagaaaaatgacgaaactgcccacatcattgcttcactaccccaccggttcataccgcttttcaagcaaattctctccgaccgaaataccctctcctttatcctcgaagagttcaaatccgacgaagaagtaatccagagcttctgtaaatacaaaacactactacgcaacgaaaacgtgctagaaacagccgaagccctcttcaacgaactcaacagcatcgatcttactcacatcttcatcagccacaagaaactcgaaaccatatccagcgccctttgcgatcactgggacaccctgagaaacgcactatatgagcgccgtatatccgagctcaccggcaaaatcaccaagtccgccaaggaaaaggtccaacgttcccttaaacacgaggacataaacctccaagaaataattagtgccgctggaaaggaactatcagaagcattcaaacaaaagacctcggaaatactttcccacgctcacgccgcgctagaccaaccgctacctacgaccctcaaaaagcaagaagagaaagagatcctaaaatcccaactagactcactcctaggactgtaccatctcctcgactggttcgcagtggatgaaagtaacgaagttgacccagagttcagcgctcgcctgactggcatcaagctcgagatggaaccttcgttgagtttctacaataaggccaggaactatgctaccaaaaagccatactcggtcgagaaattcaaactgaacttccaaatgcccacgctggcgagcgggtgggacgtcaacaaggaaaagaacaacggcgcaatactattcgtcaagaacggactttactacctgggcatcatgcctaaacaaaagggccgctacaaagcactctcattcgaacccaccgagaaaacaagcgaaggctttgacaaaatgtactacgactacttcccagacgcagccaaaatgatcccaaaatgcagcacccaactcaaagccgtcacagcccacttccagacacacaccacgcccatcctactgtccaacaacttcatcgaaccccttgaaatcaccaaagaaatctacgatctgaacaacccagagaaagaacccaagaaattccaaaccgcctacgcaaagaaaacaggcgatcaaaaagggtaccgagaagccttatgcaaatggatcgacttcacgcgcgacttcctaagcaaatacaccaaaactacctcaattgaccttagctccctacgcccatcctcacaatacaaagacctcggagagtattatgccgaactaaaccccctcctataccacatttctttccagcggatcgccgagaaggaaatcatggacgccgtcgaaacagggaaactctacctctttcagatctacaacaaagacttcgccaaaggccaccacggaaagcctaaccttcacacgctctattggaccggcctattctccccagaaaatctagcaaaaacatccatcaagctcaacggtcaagccgagctcttttaccgccccaagtcccgcatgaaaagaatggcgcacagacttggcgagaaaatgcttaacaagaaactcaaagaccaaaagactcccattccagacacgctctaccaagaactctacgactacgtcaaccaccgactgtctcacgacctttccgacgaagccagggcactcctcccaaacgtaatcactaaagaggtcagccatgagatcataaaagaccgacgtttcacgagcgataaattcttcttccacgtacccatcacacttaattaccaagcagccaactcaccatccaaatttaaccaacgcgtcaacgcctacttgaaggaacatcccgaaacccccatcatcggcatcgatagaggcgaacgtaacctgatctatatcaccgtcatcgacagcacgggaaaaatactcgaacaacgatcccttaacaccatacaacaattcgactaccagaaaaagctcgataaccgagagaaggaacgagtagccgcacgtcaagcctggtcggttgtgggaaccatcaaagacctcaagcagggatacctctcacaagtaatccacgaaatagtagacctcatgatccactaccaagcggtcgtagtactcgaaaacctcaacttcggcttcaagtcgaagcgaaccggaatcgccgaaaaagccgtataccaacaattcgagaaaatgcttattgacaagctcaactgccttgtcctaaaagattacccagccgaaaaagtaggaggagtactgaacccctaccaactcaccgaccagttcacctcatttgctaaaatgggcacccaatcaggatttcttttctacgtgcccgctccctacaccagcaaaatcgacccattaaccggcttcgtcgatccctttgtatggaaaaccatcaaaaatcacgaaagccgtaaacatttcctcgaaggcttcgacttcctccactacgacgtcaagaccggagacttcatcctacactttaagatgaacagaaacctcagcttccaacgcgggctaccgggcttcatgcccgcctgggacatagtcttcgaaaagaacgaaacacagttcgacgcaaaaggaacaccattcatcgcaggcaaacgaattgtcccggtaatcgaaaaccaccgattcacaggccgataccgggacctgtaccccgccaatgagctcatcgccctcctcgaagagaaaggcatcgtcttccgagatggctccaacatcctcccaaagctcctcgagaacgacgactcacacgccatcgacaccatggtcgctctgatccgcagcgtactacagatgcgcaactccaatgccgcaacaggagaagactacatcaattcaccagtcagagacttgaacggggtctgcttcgattcgcggttccagaacccagaatggcctatggacgcagacgcaaacggcgcctaccacatcgctctcaaaggtcaactcctactaaatcacctaaaagaatctaaggacctaaagctacagaacggaatatccaaccaagactggctagcctacatacaagagcttcgcaactga

SEQ ID NO: 6939 - RNA, 3903 nt, synthetic construct
  misc_feature 1..3903: note = Cpf1 variant
  source 1..3903: mol_type = other RNA
atgtccatataccaggagttcgtaaacaaatacagcttatccaaaacactccgcttcgaattgataccccaaggaaaaactctcgagaacataaaagcacgagggctcatactcgatgatgaaaagcgagcaaaggactacaagaaggcaaaacaaataatagacaagtatcaccagtttttcatagaggagatcctatcctcagtctgcatcagtgaagaccttctccaaaactactcagatgtctacttcaaactaaagaaatctgacgatgacaacctccagaaggatttcaaatccgccaaagacaccatcaaaaagcaaatatccgagtacatcaaagattcggaaaaattcaaaaatctgttcaaccaaaacctgatcgacgccaagaaaggacaggagagtgacctcatactgtggctaaagcagagcaaagacaacggcatcgaactatttaaagcgaactctgacatcaccgatatcgacgaggcgctagaaataatcaaatcattcaaaggctggactacctacttcaaagggttccacgaaaatcgcaagaacgtgtactcctcaaacgacatcccgacctccataatctaccgcatagtggacgacaatctgcccaaattccttgagaacaaagcgaaatacgagtcattgaaagacaaagcccctgaagccataaactacgagcaaattaaaaaggatctcgcggaggagctcaccttcgacatagactacaaaacctcagaagtcaaccaaagggtgttctccctagacgaagtattcgagatcgccaacttcaacaactaccttaaccaatcgggaataacgaagtttaacaccatcatagggggtaaattcgtcaatggcgaaaacaccaagcgcaagggaatcaacgaatacattaacctctactcccagcagataaatgacaaaacgctcaagaaatacaagatgagcgtcttattcaagcaaatactatcagatacagaatccaagagcttcgtgatagacaaactcgaagacgactccgacgtagttaccaccatgcagagcttctacgagcagattgcagcgttcaaaacagttgaagagaagtccatcaaggagacgttgtccctcctcttcgatgacttaaaggcgcagaaactagacctctctaaaatctacttcaaaaacgataaaagcctaaccgacctatcccagcaagtattcgacgattactcagtgatcggaacagccgtcctagaatatataacccagcaaatagcacccaagaacctggacaatccaagcaagaaagagcaagagctgatagccaaaaagaccgaaaaagcgaagtacctctccctggagaccatcaagttagcgcttgaagagttcaataagcaccgagacattgacaagcagtgcagattcgaagaaatcctcgccaatttcgccgccatccccatgatctttgacgaaatcgcccaaaacaaggacaacctggcacaaatatccataaagtaccagaaccaaggcaagaaagacctactacaggcaagcgccgaagacgacgtcaaagcgatcaaagacttactggaccaaactaacaacctactacataagctcaaaatattccacatctcgcagtcggaagacaaagccaacatcctagacaaagacgagcatttctacctagtcttcgaggagtgttacttcgaacttgccaacatcgtcccgttatataacaaaatccgcaactacatcacccaaaaaccctactcagacgaaaagtttaaacttaacttcgaaaactcaaccctggcaaacggatgggacaagaacaaggaaccagacaacacagccatccttttcataaaagacgacaaatactacctcggagtgatgaataaaaagaataacaaaatcttcgatgacaaagccatcaaagaaaacaaaggggagggctacaagaaaatagtctacaaactcctgccgggtgccaacaaaatgctccccaaggtattcttctctgccaaatccatcaagttctacaacccttccgaggatatattacgaattaggaaccattccacccacacaaagaacggctcaccccaaaaaggctacgagaaattcgagttcaatatcgaagactgtcgcaagttcattgacttttacaagcagagcatatcaaaacatcccgaatggaaggacttcgggtttcgcttcagcgacactcaacgctacaactcgatcgacgagttctacagagaagtcgaaaaccaaggctacaaactcacctttgagaacatatcggaatcgtacatagacagcgtagtcaaccaaggcaaactatacctgttccaaatatacaacaaggacttctctgcatacagcaaaggccgaccaaacctgcacacactctactggaaggctctcttcgacgaacgtaacctgcaagacgtggtatataaacttaacggcgaagctgaactcttttaccgaaagcaatccatccccaagaagattacacatccagcaaaagaggccatagccaacaagaacaaagacaaccccaaaaaggagtcagtatttgaatacgacctcatcaaagataaacgcttcaccgaagacaaattcttcttccactgccccattacgataaacttcaaatcatctggcgccaacaaatttaacgacgaaatcaacctgctcctaaaagaaaaggccaacgatgtacacatactatcgatagacaggggcgaacggcacctcgcctactacacgctcgtcgacggaaaaggaaacatcatcaagcaagacaccttcaacataatcggcaacgaccgcatgaaaacgaactaccacgacaagctagcagcgattgagaaggaccgagatagcgcacgcaaggactggaagaaaatcaacaacatcaaagagatgaaagaagggtatctctcccaagtcgtccatgaaatagcgaaactcgtcatcgaatacaacgccatcgtagtgttcgaagacctaaacttcgggttcaaacgaggacgatttaaagtggaaaaacaagtctaccaaaaactagaaaagatgctaatcgagaagctgaactacctcgtctttaaagacaacgagttcgacaaaaccggaggagtgttacgcgcctatcaactcaccgccccattcgaaacgttcaaaaagatgggcaaacaaacaggcataatctattacgttcccgccggctttacttcaaaaatatgccccgtgaccggcttcgtaaaccaactctaccccaagtatgaaagcgtatcaaaatctcaagaatttttcagcaaattcgacaaaatctgctacaacctggacaagggatacttcgagttctccttcgactacaagaacttcggggacaaggccgcaaaaggcaagtggaccatcgcctccttcggcagccgcctcataaacttccgcaattccgacaaaaatcataactgggacacacgagaagtctatccaaccaaagagctagagaaactcctcaaagactactccatagagtacggtcacggcgagtgtatcaaggccgccatatgcggagaaagcgacaagaaattcttcgccaaactgacctctgtcctaaacaccattctccaaatgcgcaattccaaaaccggcactgaactcgactacttaatatcccccgtagccgatgtcaacggcaacttcttcgacagtcgacaagcgcctaagaacatgccgcaagacgcggacgcaaacggcgcgtatcacatcggcctaaaaggcctgatgctgctcggacgaatcaaaaacaaccaggaaggaaagaaattgaacctagtcatcaaaaacgaagaatacttcgagttcgtccagaaccgcaacaactga

SEQ ID NO: 6940 - RNA, 1341 nt, synthetic construct
  misc_feature 1..1341: note = Cpf1 variant
  source 1..1341: mol_type = other RNA
atgaaaccagacatcaaagaccgcgaatacatgtaccgactcatcattggacaactcttctacgacggtcaccaacaaatagcagtcaatctcgcaaacaccctaggatgctcagccccacccccaccaccctcagacaaactcttccgacttgtcaccatcgccaaacaattcgttgaagaccccgactacaaagccgaggaaaacaccatgcccatgcaattcgaaacctcatcagccggactcgacctacaatacgacgccgacgttgccgcgacctcacccgaacccagccaatatgaaaccatatacctaaccgtacacaaagcaccctgccgagccgcagccttcaactccgatggatccctaatcgcgacaggctccgccgactgctcaatcaaaatcatggacgtcgaacgaatcctcgcacgagaaaaagaacaccgcgaaatgaacgaaaacggacccgacgcacatcaccccgtaatccgcactctctacgaccacgtcgacgtccgccgcgatttcggcagattcagcgacaaaatcctagacttccaagacgtcaacaccgtaatattccacccccgagacgccatcctaataagcggctccaacgataaaaccgtcaaactcttcgacttcagcaaaactgcagtcaaacgcgccatgaaaaccctctcagaggtctaccccgtacgagcactcagctgccacccaggaggtgagttcctactcgtcgccaccgaccaccccacagtccgcctttacaacatagaaacggcccaagcatacgccagcgccaaccccgacgaccaacaccgtgaatcagtgacagacgtccactactccgaaaatgcacgactatacgtcacagccagcaaagacggcgatgtaaaagtctgggacggcgtctcctcccgatgcgtcgaaacctttaaaagagcccacgacggatcctccatctgctcagcaaaattcaccaaaaacggcaaatatatactcacatccggcatggactccatcgtcaaactctgggaactctcaacaaaccgatgcctaatagtctacacaggcgcaggagcgacaggcgcacaagactaccccacctcagcctccttcaaccaaaacgaagacttcgtcctcttccctgacgaaaaatccggctccatgtgctcctgggaagcacgcaacgccgaccgcaaaagactcctcgccctcggccacaccagcgcctgccgaaccttcgtccactccccctccatgcccgccttcatgacaggctccgacgaccatcgcgcacgattctggtaccgaaaacccaccacaaacgacaactga

SEQ ID NO: 6941 - RNA, 1293 nt, synthetic construct
  misc_feature 1..1293: note = Cpf1 variant
  source 1..1293: mol_type = other RNA
atgaagcctgacatcaaggaccgagaatacatgtaccgcctaatcatcggtcaactcttctacgacggccaccaacaaatagcagtcaccctcgctaacacactcggctgctccgcacccgcacccccaccatctgacaaactctaccgcctagtcacaatcgccaaacaattcgtagaagaccccgactataaagccgaagaaaaatccctacccatgcaattcgaaaccgtctccacaggcctcgacctcgaatacgacgccgacgtccaaccagtatccccagaaccatcccaatacgaaacaatatatctcaccgtccataaagccccctgtcgcgccgccgccttcaattcagacggctccctcgtcgccaccggctccgccgactgctccatcaaaatcatggacgtagagcgtatcctcgcaagagaaaaggaacaccgagaaatgaacgaaaacggcccagatgcccaccaccccgtcataagaaccctatacgatcacgtcgacgacgttaacaccgtcctcttccaccccagagacgcaatactcatctccggaagcaacgacaaaacagtcaaactattcgacttctccaaaaccgccgtaaaacgggccatgaaaaccctctcagaagtctaccccgtacgcgctctatcatgccaccccggcggagagttcctcctagtcgccaccgaccatcccaccgtcagactatacaatatagaaaccgcacaagcctacgcttccgccaacccagacgaccaacaccgagaatccgtcaccgacgtgcattactcagaaaacgcccgactatacgttaccgcctctaaagacggtgatgtcaaaatctgggacggagtcagcaaccgctgcgtcgaaactttcaaacgcgcacacgacggatccgccatctgctcggccaaattcaccaaaaatggcaaatacctactcacctccggcatggactccatcgtaaaactctgggaactctccacaaaccgatgcctcatagtctacaccggcgccggcgcaaccggcgcacaagactacgccacctcagcatcctttaaccacaacgaagactacgtactcttcccagacgaaaaatccggctccatgtgctcttgggacgcccgcaattcagaccgcaaacgcctcctcgccctaggtcacacttccgcatgccgcacctttgttcactcaccatccatgcccgccttcatgaccggctcagacgaccaccgagcccgcttctggtaccgcaaaccagcaaccaccgacaactga

SEQ ID NO: 6942 - RNA, 3690 nt, synthetic construct
  misc_feature 1..3690: note = Cpf1 variant
  source 1..3690: mol_type = other RNA
atggcagcaagcaagttggaaaagttcaccaactgttactccctctccaaaaccttaagattcaaggcgatacctgtcggaaaaacccaagaaaacatcgacaataaacgcctattagtcgaggacgaaaaacgcgccgaagattacaaaggggtaaagaaactgctcgaccgatactatctatcgttcatcaacgatgtcctacacagcatcaagctcaagaacttgaacaactacataagtctgttcaggaaaaagacacgaaccgagaaagaaaacaaggagctggagaacctcgagatcaacctacgaaaggaaatcgccaaggcatttaaaggagccgccggctataagagcctattcaagaaagacatcatagaaacgatcctccccgaggccgcagacgacaaggacgaaattgctctcgtaaactccttcaacgggtttacaaccgcgttcacagggttctttgacaaccgtgagaacatgttcagcgaggaggctaaaagcacctcaatagccttccgctgcatcaacgaaaacctcactcgatacatcagtaacatggacatcttcgaaaaagttgacgcaatattcgataagcatgaagtccaggaaataaaagaaaagattctcaactccgactacgacgtggaggactttttcgaaggggagttcttcaacttcgtcctcacacaagaaggcatagatgtgtacaacgccatcatcggaggttttgtgaccgaatctggcgaaaagataaaaggactgaacgagtacattaacctttacaatgccaaaactaaacaagccttacccaagttcaagcccctctacaaacaagtgctgtccgaccgagaaagcctatcattctacggcgaaggatacacctctgacgaggaggtactagaagtcttcagaaatacgctgaacaaaaactccgaaatattcagcagcatcaaaaagctagaaaaacttttcaaaaactttgatgaatattcaagcgccggcatattcgtgaaaaatggccccgcgatctcaaccatatccaaagacatattcggagaatggaacctaatacgcgataagtggaacgcggaatacgatgacatccacctaaagaagaaagccgtcgtaaccgaaaaatacgaggacgacagaaggaaatcgttcaagaaaattggctcgttctccctagaacagctccaagaatacgcagacgcagacctctcagtcgtagaaaaactcaaggagataataattcagaaggtagacgaaatctacaaagtgtacggaagctcagaaaagctattcgatgcggacttcgtactggagaagagtctcaagaaaaacgacgccgtcgtagccatcatgaaagacctcctcgactctgtcaaatcgttcgagaactacataaaggcattcttcggtgaaggaaaggagaccaaccgcgacgagagcttctacggagacttcgtgctagcctacgatatcctcctcaaggttgaccacatctacgacgcaatacgaaactacgtgacccaaaaaccgtattcgaaggacaaattcaaactctacttccaaaacccacagttcatgggcgggtgggacaaggacaaggaaaccgactaccgggccaccatactccgttacggctccaaatactacctggcaattatggacaagaagtacgcaaaatgcctccagaaaatcgacaaagacgacgtcaatggcaactacgagaaaatcaactacaaactgctaccaggccccaacaagatgctcccaaaagtgttcttctccaaaaagtggatggcctattacaacccatcagaagacattcagaaaatctacaagaacggcactttcaagaaaggagacatgttcaacctcaacgattgccataagctgatagatttcttcaaggactccatctcccgatacccaaaatggagcaacgcgtacgatttcaattttagcgaaaccgaaaaatacaaggacatcgcagggttctaccgagaagtagaggaacaaggttacaaagtctcgttcgaaagcgcgtccaaaaaggaagtagacaagctcgtagaagaaggcaagctctacatgttccaaatatacaataaagacttctcggacaaatcccacggcactccaaacctccacaccatgtacttcaaactactattcgatgagaacaatcacggacaaatcagactctccggcggggcagaactgttcatgcgccgcgcatcgcttaaaaaggaggagctcgtagtgcaccccgctaactccccgatcgccaataaaaatccagacaaccccaagaagacaacaaccctaagctacgacgtatacaaagacaagaggttcagcgaggaccaatacgaactacacattccaatagccatcaacaaatgtcctaaaaacattttcaagataaacacggaagtgcgagtactgctcaaacatgacgacaacccctacgtaataggaatcgaccgcggcgaaaggaatctactctacatcgtcgtagtagacgggaagggcaatatagtcgaacaatactcgctaaacgaaatcatcaacaacttcaacgggatccgaatcaaaaccgactaccacagtctgctagacaagaaagagaaagaaagattcgaggcccggcaaaactggacgagcatcgagaatatcaaagaactcaaagccggttacataagtcaagtcgtacacaaaatctgcgagctcgtagaaaaatacgacgccgtaatagcccttgaagacctaaacagcggctttaagaacagccgagtcaaagtggaaaagcaagtataccaaaaattcgaaaagatgctcatagacaagctcaactacatggtcgacaagaaaagcaacccgtgcgccaccggaggcgccctcaaaggctaccaaataacgaacaaattcgagagcttcaaaagcatgtccacacagaacggcttcatattttacatacccgcatggctgacaagcaaaatagacccatcaacaggcttcgtaaacctcctaaaaacaaaatacaccagtatcgcagactcgaagaaatttattagcagctttgaccgaatcatgtacgttcctgaagaggaccttttcgagttcgcccttgactacaagaactttagccgtaccgacgccgactatattaaaaagtggaagttgtactcatacggtaacagaatccgcatattcgccgcagcgaagaaaaataacgtattcgcctgggaagaggtctgcctcacaagcgcgtacaaagaacttttcaacaaatacgggatcaactaccagcagggagacataagggcactgctgtgtgaacaaagcgacaaagcgttctacagcagcttcatggccctcatgagcctcatgctgcagatgcgcaattccataaccggcaggaccgatgtcgactttctgatcagcccggtcaaaaattccgacggcatattctacgactcaaggaactatgaagcccaggaaaacgcaattctgccgaagaatgcagacgcgaacggcgcatataacatcgcgaggaaggtcctctgggccattgggcagttcaagaaagcagaagacgaaaaactggacaaggtcaagatcgccatcagcaacaaagaatggctggaatatgcacagacgtcagtcaagtga

SEQ ID NO: 6943 - RNA, 3903 nt, synthetic construct
  misc_feature 1..3903: note = Cpf1 variant
  source 1..3903: mol_type = other RNA
atgtccatttaccaagagttcgtaaacaaatactcgctctcgaagacattacgcttcgaactaatcccgcagggaaaaacactcgaaaacataaaagcccgcggcctcatcctggatgacgagaaaagagccaaggactacaaaaaggcaaaacagataatagacaaatatcaccaattcttcatcgaggaaattctaagctctgtctgcatcagcgaagacctcctccaaaactacagtgacgtctacttcaagctcaagaaatcagacgacgacaacctacaaaaagacttcaaatccgcgaaagacactattaagaaacagataagcgaatacataaaagactctgaaaaattcaaaaaccttttcaaccagaacttgatagacgctaagaaaggccaggaatcagatctcattctgtggctcaagcaatcgaaagataacggaatcgaactcttcaaagccaactcagacatcaccgatattgacgaagcactggaaatcataaaatccttcaaaggatggaccacatacttcaagggattccacgaaaaccgcaagaacgtatactcgagcgacgacatccccactagcatcatctaccgaatcgtggacgacaatctcccgaaatttctagagaacaaggcaaaatacgaatccctaaaagacaaggcgcccgaggccatcaactacgaacagatcaaaaaggaccttgccgaagaactcacgttcgacatcgactataaaacatcggaggtaaaccagcgggttttcagcctcgacgaagtgttcgagattgccaacttcaataactaccttaaccagtctggcataactaagttcaacactataatcggcgggaaattcgtcaacggagaaaacacaaaacggaaaggaatcaatgaatacatcaacctctactcccaacagatcaacgataagacactcaagaaatacaaaatgtccgtcctgtttaaacaaatcttgtccgacacagaaagcaaatccttcgtaatcgacaagctcgaagatgatagcgacgtcgtcaccacgatgcagtctttttacgaacaaatcgccgcattcaagacagtcgaagagaaatctatcaaggaaacactatcgctcctgttcgacgatctgaaggcccaaaaactcgacttatccaaaatttacttcaagaacgataaatcactaacagacctcagccaacaggtgtttgacgactacagcgtgataggaaccgcagtcctagagtacataacccaacaagtcgcccctaaaaacctcgataatccatcaaagaaagaacaagacctaatcgcgaagaaaaccgagaaagcaaaatacctcagtctggagaccatcaaactcgcattagaggagttcaacaaacatcgcgacatagataaacaatgccgattcgaagaaatacttgccaactttgctgcaataccaatgatctttgatgagatcgcacaaaacaaggataacttggcccagatctccctcaaataccaaaaccagggtaagaaagacctgctccaggccagcgccgaagaagatgtcaaagccatcaaagaccttctggatcaaaccaacaacctcctacaccgcctcaaaatattccacatttcccagtccgaggacaaagcgaacatcctagacaaggacgagcacttttacctcgtcttcgaagaatgttacttcgagcttgcaaatatagtaccactctacaacaaaattcggaactacatcacccaaaaaccctactcagacgagaagttcaaactgaacttcgagaactcaacactagcaaacgggtgggacaaaaacaaagaaccagacaacaccgccatcttattcataaaggacgacaagtactacctcggtgtcatgaataagaaaaacaacaaaatattcgacgacaaagccatcaaagagaacaagggcgaaggctacaagaaaattgtgtacaaactcctgcccggagctaacaaaatgctgcccaaagtcttcttcagcgcaaaatcaatcaaattttataacccctccgaagacatcttacgaataagaaatcactctacccacacgaagaacggaaacccgcaaaaaggttacgaaaagttcgagtttaacattgaggactgccgtaaattcatcgacttctacaaagagtccatctcaaaacatcccgaatggaaagacttcggcttccgcttcagcgacacccaacgctacaacagcatcgacgagttctaccgcgaggtcgagaaccaaggatataagctaacattcgagaacatctccgagagctacatcgacagcgtggtcaaccaggggaagctatacctgttccaaatctacaacaaagacttctcagcgtactcaaaggggcgaccaaacttgcacacgctctattggaaggctctattcgatgagcgcaacttacaggacgtagtctacaagctaaacggagaggccgaactcttctacaggaaacaaagcatcccgaagaaaataacgcacccagccaaagaagcgatcgcaaataaaaacaaagacaacccgaagaaggaatcagtctttgaatacgacctaatcaaagacaagcgcttcactgaggacaagttcttcttccattgtccaatcacaatcaacttcaaaagctcgggggcaaataagttcaacgacgaaataaacctcctactcaaggaaaaggcgaacgacgtccacatcctctcaatagacagaggggagcgccatcttgcctactacactcttgtcgatggaaaaggcaacataatcaaacaagacactttcaacatcatcggaaacgaccgtatgaaaaccaactaccacgacaaactcgccgccatagagaaggaccgcgactcagctcgcaaggactggaagaaaatcaacaacataaaggagatgaaagagggctacctttcgcaggtcgtacatgaaatcgcgaagctagtcatagaacacaacgctatcgtggtattcgaagacctaaacttcgggttcaaacgcggccgattcaaagtggaaaaacaagtataccaaaaactcgaaaagatgctcatcgagaaactgaactacctcgtattcaaagacaacgagttcgacaaaaccggtggagtcctgcgcgcctaccaactcaccgcgcccttcgaaactttcaaaaagatgggcaagcagacaggcatcatatactatgtcccagccggcttcacctccaagatatgtccagtcacgggattcgtcaaccaactctaccccaaatacgaatccgtctccaagagccaggaatttttcagcaaatttgacaaaatatgctacaacctggacaaaggctatttcgaatttagctttgattacaaaaacttcggcgacaaagcggccaagggaaaatggaccatagccagcttcggatcacgcttgatcaacttccggaacagtgacaaaaaccacaactgggatacgcgagaagtgtacccaacgaaagaactagaaaaactcctcaaagactactcgattgaatacggtcatggcgaatgcataaaggcagcaatttgcggtgaatccgacaagaagttcttcgcaaaactcacgtctgtactcaacacaatcctacagatgcgcaacagcaagaccgggaccgagctagactacctcatctcccccgtggcggacgttaacggaaacttctttgacagccgacaagcaccaaagaacatgccccaagacgccgacgcaaacggcgcgtaccatatcgggctcaaaggcctcatgctcctagaccgcattaaaaacaaccaagaggggaaaaagctcaacttagtgatcaagaacgaagaatactttgagttcgttcagaatagaaacaactga

SEQ ID NO: 6944 - RNA, 1071 nt, synthetic construct
  misc_feature 1..1071: note = Cpf1 variant
  source 1..1071: mol_type = other RNA
atgaaaaccaactaccacgacaaactcgccgccatcgaaaaagaccgagaaagcgcgcgaaaagactggaagaaaatcaacaacataaaagaaatgaaagaaggatacctgtcccaggtcgttcacgaaattgccaaactggtcataggctacaacgcgatagtggtcttcgaagacctcaacttcgggttcaaacgcggccgcttcaaagtagaaaaacaagtctaccaaaaactcgagaaaatgctaatagaaaaactaaactacctcgtcttcaaagacaacgaatttgacaaagccggcggcgtgctccgagcctaccaactgaccgcccccttcgaaacattcaagaaaatgggaaaacaaacaggcatcatctactacgtaccggcagatttcacatcaaaaatatgccccgtcaccggcttcgtaaaccaactataccccaaatacgaatccgtatcaaaatcacaggaatttttcagcaaattcgacaaaatctgctacaacctcgacaaaggctacttcgaattttcattcgactacaaaaatttcggcgacaaagcagccaaaggcaaatggacaatcgcgagcttcggctccagactaatcaacttccgcaactcagacaaaaaccacaactgggacacacgagaagtctatcccaccaaagaactcgaaaaactccttaaagactacagcatagaatacggccacggcgaatgcataaaagccgcaatatacgcagaaaacgacaagaaattcttcgccaaactcacatccatactgaactcgatcctccaaatgcgcaacagcaaaaccggaaccgaactcgactacctcatctcccccgtcgccgacgtcaacggcaacttcttcgactcgcgacacgcccccaaaaacatgccacaagacgccgacgccaacggcgcgtaccacataggactcaaaggcctcatgctcctgtacagaatcaaaaacaaccaagacggaaagaaactcaacctcgttatcaaaaatgaagaatacttcgaatttgtccaaaaccgcaacaaatccagcaaaatctga

SEQ ID NO: 6945 - RNA, 3792 nt, synthetic construct
  misc_feature 1..3792: note = Cpf1 variant
  source 1..3792: mol_type = other RNA
atggaggactactccggattcgtcaacatctactccatacagaaaacactacggttcgagctgaaaccagtcggcaagaccctcgagcatatcgagaagaaaggcttcctaaagaaggataaaattcgcgcagaggactacaaagcggtcaagaaaataatcgataaataccaccgagcgtatatagaagaagtcttcgacagcgtcttacatcagaagaaaaagaaagacaaaacccggttctccacacaattcataaaagaaataaaagagttcagcgaactatactacaaaacagagaaaaacatacccgacaaagaacgcctcgaagccctatcggaaaaattacgaaaaatgctagtcggcgcgttcaaaggagagttcagcgaagaagtcgcagaaaaatacaagaacctattctccaaagaacttataaggaacgaaatcgaaaagttctgcgagaccgatgaggaacgaaaacaagtatccaacttcaagagtttcaccacgtacttcaccggcttccacagcaacagacaaaatatatacagcgacgagaagaaaagcaccgcgatcggttaccgcataatccatcaaaatttgcctaagttcctcgacaacctaaaaattatagaaagcattcaacgccgcttcaaggacttcccatggtcagacctcaaaaagaacctaaagaaaatagataaaaacataaaactcaccgagtacttctcgatcgacggcttcgttaacgtcctcaaccagaaggggattgacgcctacaacactatcctcggcggcaaatccgaggaatccggagagaaaatccaaggtcttaacgaatacataaatctgtaccggcaaaagaacaatatcgacagaaagaacctacccaacgtaaagattctgttcaaacaaatacttggggaccgggaaacaaaatccttcatccccgaagcattccccgacgaccagtccgtgctcaacagcatcacagagttcgccaaatacctaaaactcgacaaaaagaaaaagagcatcatcgcagagctcaaaaagttcctatcatcgtttaaccgctacgaactggacggcatctatttagctaacgacaactcactcgcatcgataagcactttcctgttcgacgactggagcttcatcaagaaatccgtatccttcaagtacgacgaatccgtcggcgaccccaagaagaaaatcaaaagtcccctgaaatacgaaaaagaaaaagaaaaatggctcaaacagaagtattacaccatcagcttcctgaacgacgccatcgaatcgtactcaaaaagccaggatgaaaaacgggttaagatccgcctcgaggcttacttcgcagagttcaaatccaaggatgacgctaagaaacaattcgaccttctcgaacggatcgaagaagcctacgccatcgtagaacccctacttggagcggaatacccccgcgaccgcaacttaaaagccgacaagaaagaagtggggaaaatcaaagacttcctcgactcgattaagagcctgcaatttttcctaaagcctctcctctcagccgaaatattcgacgaaaaggacctcggcttctacaaccaactggaggggtactacgaggaaatagactccataggccacctttacaacaaggtgcgaaactatctaaccggcaaaatttactccaaagaaaaattcaagctcaacttcgaaaacagcaccctcctgaaaggatgggacgagaaccgcgaggtcgcaaacctctgcgtcatcttccgggaggaccaaaagtactacctaggagtaatggacaaggagaacaacacaattctaagcgacatacccaaggtcaaacccaacgaactattctacgagaagatggtatacaaactaatacccacaccccacatgcaactacctaggatcatcttcagctccgacaacctgagcatatacaacccaagcaaatcaattctaaagatcagggaagccaaatcattcaaagaaggcaaaaacttcaagctaaaggattgccacaaattcatcgacttctacaaagaaagcattagcaaaaacgaggactggtcccgcttcgacttcaaattttcaaaaaccagctcatatgagaacatcagcgagttctacagagaagtcgaacgccagggctacaacctggatttcaagaaagtcagcaaattctacatcgactcactcgtagaagacggcaaactatacctctttcagatatataacaaagacttctccatattcagcaaagggaaaccaaacctccacaccatctactttaggtcattattcagcaaagaaaacctcaaggacgtgtgcctaaagctgaacggcgaagcggagatgttctttcgcaagaaaagtatcaattacgacgagaaaaagaaacgcgaaggacatcaccccgaactcttcgaaaaacttaaataccccatactaaaagacaaacgctacagcgaggacaaattccaattccacctaccgatctccctcaacttcaaaagtaaggagcgactaaacttcaacttaaaggtcaatgagttcctaaagcgcaacaaagacatcaatattatcggaatcgaccggggcgaacggaacctcctctaccttgtcatgataaaccagaaaggagaaatcctcaaacagaccctcctcgacagcatgcaaagcggtaaagggcgaccagaaatcaactacaaggaaaagctgcaagaaaaagaaattgaacgggacaaagctagaaagtcttggggcactgttgaaaacataaaagaactcaaagaaggctatctgagcattgtaatccaccaaatcagcaagctcatggtagaaaataacgccatcgtagtgctggaagacctcaacatagggttcaagagaggtcgacaaaaggtagaacgccaggtctaccagaaattcgagaaaatgctaattgacaaactcaacttcctggtcttcaaagaaaacaaaccaaccgaaccaggaggggtcctgaaggcttaccaactcacagacgagttccagagcttcgaaaaactaagcaaacaaacaggtttcctgttctacgtgccgtcctggaacaccagcaaaatcgacccacgcacaggattcatcgacttcctacaccccgcatacgaaaacatagaaaaagccaaacaatggatcaataagttcgacagcatccgcttcaacagcaagatggactggttcgagttcacggccgacaccagaaaattctcagaaaatctaatgcttggaaagaaccgggtgtgggtgatttgcaccacgaacgtcgaacgctacttcacatccaaaacagccaacagcagcatccaatacaacagtatacaaataacggaaaaactaaaggaactattcgtcgacatacccttctcaaacggacaggacctcaaaccagaaatcctccgtaaaaacgacgccgtattctttaagtcgctcctgttctacataaagaccacactatccctgcgacaaaacaatggcaaaaagggagaggaggagaaggacttcatcctctcccctgtcgtcgacagcaaggggcggttctttaacagcctagaggcttcggacgatgaacccaaggacgccgatgccaatggcgcttaccacatcgcactaaaaggcctgatgaacctattggtactcaacgagaccaaggaagaaaacctcagtcgacccaaatggaagataaagaacaaagactggctagagttcgtatgggaacgaaaccgctga

SEQ ID NO: 6946 - RNA, 2820 nt, synthetic construct
  misc_feature 1..2820: note = Cpf1 variant
  source 1..2820: mol_type = other RNA
atgaacctctactcgaacctaaccaacaagtacagcctatccaagacgctacgctttgaactgatcccccaaggcgaaacactagaaaacatcaaggcccgaggcctaatcctcgacgacgaaaaacgcgccaaagactacaaaaaggcaaaacagatcatcgacaaataccaccagttctttatagaggagatactctccagtgtctgcatatcagaagacctcctccagaactactccgacgtctacttcaaactaaagaaatcggacgatgacaacctccaaaaagacttcaaatccgccaaagacaccatcaaaaagcacataagtcgctacataaacgactccgaaaaattcaaaaatctcttcaatcagaacctcatcgacgccaaaaagggtcaagaatcagacctaattctctggctgaaacaaagcaaagacaatgggatcgaactattcaaagcgaactccgacataaccgatatagacgaagccttggagatcatcaaatccttcaaaggatggacaacttacttcaaaggatttcacgaaaaccgtaagaacgtctactcatccgacgacatccccacctccatcatctaccgcattgtcgatgacaacctacccaagttcatagaaaacaaagccaaatacgaaaacctaaaggacaaggccccagaagccataaactatgagcaaatcaaaaaggacctagccgaggagctaaccttcgacatagactacaaaacctcagaggtcaaccaacgtgtcttctccctcgacgaagtcttcgagatagcaaacttcaacaactacctcaatcaatccggcataacgaaattcaacaccatcatagggggaaaattcgtaaacggtgagaacaccaaacgaaaaggtatcaacgaatacatcaatctatattcccagcagatcaacgacaagaccctaaagaaatacaaaatgtccgtcctcttcaaacaaattctgtccgacaccgagagcaaatccttcgtaatcgacaagctagaagacgactctgatgtcgtaacgacgatgcaatccttttatgaacaaatagcagcctttaaaacactcgaagaaaaatcaatcaaagagaccctttccctcctcttcgacgacctcaaagcccaaaaacttgacctatctaaaatttacttcaaaaacgacaaatccctaaccgacctctcccaacaagtattcgatgactacagtgtcataggcaccgcagtcctggaatacatcacccaacaagtggcgccaaagaacctcgacaaccccagcaaaaaggagcaggacctcatcgccaaaaagacagaaaaagcaaagtacctcagcctcgaaacgatcaaactcgccctcgaggagttcaacaaataccgcgacattgacaaacaatgcaggttcgaagaaatcttcgcctcattcgccgacataccggtactcttcgacgaaatagcacaaaacaaaaacaacttagcacagattagcattaagtaccaaaaccaagggaagaaagacctactacaaacaagcgccgaagtcgacgtaaaagcgattaaagacctcctcgaccagaccaacaacctcctccacaaactcaaaatattccacataacccagagcgaagacaaagcaaatatcctcgacaaagacgaacacttttacctggtcttcgacgaatgctattttgaactcgcaaacattgtcgccctctacaacaaaatccggaactacatcacacaaaaaccttacagcgacgaaaaattcaagctcaatttcgagaactcaaccctcgccaacggctgggacaagaataaagagcccgataacacagcgatattattcatcaaggacgacaaatactacctcggcgtgatgaacaaaaagaacaacaagatcttcgacgacaaagcgataaaagaaaacaagggtgaaggatacaagaaagtcgtatacaaactactccccggcgcgaacaaaatgctcccgaaggtcttcttctcagccaaatcaataaacttctacaatccctcagaggacatactacgcatcagaaaccacagcacccacacaaagaacggaagccctcagaaaggatacgaaaaactggagttcaacatagaagactgcagaaaattcatcgatttctacaagcactcgatctcccgccatcccgaatggaaagacttcggcttccgattttccgacaccaagaagtacaactccatagacgaattttaccgcgaggtcgaaaaccaaggatacaagctgacatttgagaacatatccgaaagctatatcgactccctcgtagacgaggggaaattatacttattccagatatacaacaaagactttagcgtctactctaaaggcaagcccaacctccatacactctactggaaagccctctttgacgaacgcaacctacaagacgtagtctacaaactcaatggagaagctgaactcttctacagaaaacaaagcatccccaagaaaatcacccatccagcaaaagaagccatcgccaacaaaaacaaagacaaccccaagaaagaaagcatcttcgaatacgacctcataaaagacaaacgctttacagaggataaattcttcttccactgccctataacaatcaacttcaaatcctcgggcgccaataaattcaatgacgaaatcaacttactactaaaagaaaaagcaaatgacgtgcacatcctatctatcgaccgcggcgaacgccacctagcctattacaccctcgtggacgggaagggtaacatcatctgtaagaactga

SEQ ID NO: 6947 - RNA, 3795 nt, synthetic construct
  misc_feature 1..3795: note = Cpf1 variant
  source 1..3795: mol_type = other RNA
atgctatttcaagagttcacccacctctacccactatccaaaaccgtacgcttcgaactaaaaccaatcggaaagaccctagaacacatacacgcgaaggacttcctatcacaagacgaaaccatggcggacatgtaccagaaagtcaaagctatcctagatgactaccacagagacttcatcgccgacatgatgagcggagttgtactcaccaaactagccgagttctacgaagtgtacctcgcgctccgaaaaacgcccaaagacgattccctacagaaacaactcacagaaatccaaactgcacttcggaaagagatcgtgaaaccgatcggttccggaggaaaatacaaagcagggtatgatagactgttcggcgcgaaacttttcaaggacggaaaagaattaggagacctcgcgaagttcgtgatcacccaggaaggggaatcttcacctaaactagcccacatcgcccacttcgagaagttctcgacatacttcacaggctttcacgacaacaggaagaacatgtactccgacgaagacaaacacaccgcaatcgcttacagactaatccacgaaaacctcccccgcttcatcgacaatttacaaatcctcgcgacaatcaaacaaaaacactccgccctctacgaccaaatcgtcaacgaactgaacgccaacggcctcgacgtctcactggcctcgcacttggacggataccacaaattgctcacccaagaagggataacggcatacaatacactactcgggggaatcagcggagaagcaggcagtagaaagatacaagggattaacgaactgatcaatatccaccacaaccaacactgccagaaatcagaaaggattgccaaactaagacccctccataaacagatcctaagcgacggaatgggcgtatcgttcctcccttctaaattcgcagacgacagtgaggtctgccaggccgtcaatgaattttaccgccactacgcgcatgtcttcgccaaagtacaatcactcttcgaccgattcgacgactatagaaaggacggcatctacgtggagcataaaaacttaaatgaactaagcaagcaagcattcggagactttgcgctcttgggacgcgtactagacggctactacgtcgacgtcgtgaaccccgagttcaacgagcgcttcgcaaaagctaaaacagacaatgctaaagaaaaattgacaaaagagaaagacaaatttatcaaaggcgtgcactccctcgccagcctagagcaagccatagaacactacatcgccggacacgacgacgaatctgtacaagccggcaaacttggccagtatttcaaacacggcctagcaggcgtagacaaccccattcaaaagatacacaacagccactcaacaatcaaaggcttcctcgaacgcgaacgcccggccggcgaacgggccttaccaaaaataaagtcggataaatcgcctgagatgacccaacttagacaactcaaagagctactcgacaacgccctcaacgttgtccatttcgcgaagctcctcacaaccaaaaccaccttagacaaccaggacggcaacttctacggagaatttggggcactatacgacgagcttgccaaaatagcgaccctctacaacaaagttcgagactacttgagccaaaaacctttttcgacggagaaatacaaactaaacttcggcaacccaaccctactaaacggatgggacctcaacaaggaaaaagataacttcggcgtcattctgcaaaaagacggctgctactaccttgccctcctcgacaaggcacacaaaaaggtcttcgacaacgcccccaacgcggggaaatcagtataccagaaaatggtttacaaactacttcccggccccaataagatgctaccgaaggtcttcttcgccaaaagtaacctcgactattacaacccctcagcagaactactcgacaagtacgcgcaaggaacccacaagaaagggaacaacttcaacctcaaggactgccacgccctcatagacttcttcaaggccagcataaacaaacatccagagtggcaacactttggcttcgaattttcgccgacatccagctaccaagaccttagcgacttctacagagaagtcgaaccacaagggtaccaggtgaaattcgttgacataaacgccgaatacattgacgagctagtagaacaaggccaactgtacctcttccaaatctacaacaaagacttcagccccaaggcccacggaaaaccaaacctccacaccctctacttcaaagccctgttcagtgaaaacaacctggcaaacccgatttataaattaaacggggaagccgaaatcttctatcgaaaagcctccctcgacatgaatgaaaccactatacaccgagcgggggaggttctggagaataaaaacccagacaaccccaaaaagcgccagttcgtatacgacataataaaggacaagcgctacacccaggacaaattcatgctccacgttcccataacaatgaacttcggcgtccagggcatgacgatcaaagagttcaacaaaaaggtaaaccaatcaatccaacaatacaacgacgttaacgtaatagggatagaccggggcgaacgtcacctcctatacctaaccgtaatcaactccaaaggcgaaatcctcgaacagaggtcgttgaacgacataataacaacatcggccaacggaacacaaatgacgaccccctatcacaagattctagacaagcgcgaaatcgaacgacttaatgcgcgtgtcgggtggggcgaaatagagaccatcaaagagctcaagtccggttacctcagccacgtagtccaccaaatcagtcagctaatgcttaagtacaacgccattgtagtccttgaagaccttaacttcggcttcaaacgaggccggtttaaagtcgagaagcaaatctaccaaaacttcgaaaatgccctgattaaaaagctcaaccatctggcactcaaggacaaagcagacgacgagataggcagctataaaaacgcccttcaactcaccaacaatttcacagacctcaaaagcataggcaagcaaacaggattcctcttttacgtcccggcatggaatacgtcaaagatcgaccccgccacaggctttgtagacctcctaaaaccccgttatgaaaacatcgcacaatcgcaggcattcttcggcaaattcgacaaaatattctacaacgcggacaaagggtacttcgaattttacgtagattacgcgaaattcacggacaaagccaaaaattctcgtcagacctgggtaatctgctcccacggcgacaaacgatacgtatacgacaaaaccgcgaaccaaaacaaaggtgcaacaataggcatcaacgtcaatgacgaactgaagtccctattcgcccgctaccacatcaacgacaaacaacccaacctagtcatggacatctgccagaacaacgacaaagagttccacaagagcctaatgtacctcctaaaggcgctcctagcgctccgttattccaacgcctcatccgacgaggacttcatcctctcaccggtagcggacgacaagggagtcttcttcaatagcgctctcgccgacgacacccaaccccaaaacgcagatgccaacggcgcataccacatcgccctcaaaggtctatggctcctcaacgaactcaagaactcgaacgacctcgacaaaatcaaactagcaatagacaaccaaacctggctcaacttcgctcaaaatcgatga

SEQ ID NO: 6948 - RNA, 3903 nt, synthetic construct
  misc_feature 1..3903: note = Cpf1 variant
  source 1..3903: mol_type = other RNA
atgagcatataccaagagttcgtcaacaagtatagcctaagcaaaaccctgcgcttcgaacttattccccaagggaagaccctcgaaaacataaaagcaaggggcctgattctcgacgacgaaaaacgcgcaaaagactacaagaaagcaaaacaaatcattgataagtaccaccagttcttcattgaagaaattctttccagcgtatgcatctcagaggacctgctgcaaaactacagcgacgtctacttcaaactcaagaaaagcgacgacgacaacctacagaaggacttcaaatccgcgaaggataccatcaaaaagcaaatcagcgagtacatcaaagatagcgagaaattcaaaaacctcttcaaccaaaaccttattgacgccaagaagggccaagaaagtgacctgatcctatggctcaagcaatccaaagacaacgggatagaactattcaaagcaaacagcgacatcaccgacatcgacgaagctctggagataatcaaatcattcaaaggctggaccacctacttcaagggcttccacgaaaacagaaagaacgtatactcctcggacgacattccaaccagtataatctaccgaatcgtcgatgacaacctaccaaaattcctggaaaataaagcgaagtacgaatccctaaaggataaggcacccgaagccataaattatgaacaaatcaaaaaggacctggccgaagagttgacattcgacatagactacaaaacaagcgaagtcaaccagcgcgtattctccctcgacgaagtcttcgagatcgccaacttcaacaactacctcaaccaatccggcattaccaaatttaatacaatcatcggcggtaagttcgtgaacggcgaaaacacaaaacgcaagggaatcaatgaatatatcaatttatactcacaacagattaacgacaaaactctaaagaaatacaagatgtccgtcctattcaaacaaatactgtccgacaccgaatcgaaatccttcgtaatcgacaagctcgaagacgacagcgacgtcgtcaccacaatgcagtcattctacgagcaaatcgcagcattcaaaacggtagaggaaaagagtattaaagaaaccctctcgctcctctttgacgacctcaaagcacagaaactcgacctctcaaagatatatttcaagaacgacaagtcgctcaccgacctcagccagcaagtcttcgacgactactcagtcattggcaccgcagtcctagagtacataacgcagcaggtcgctccgaaaaacctggacaaccctagcaagaaggaacaagacctaatcgccaaaaagacggaaaaagccaaatacctatccctcgaaactataaagctggccctggaggagttcaacaaacaccgagacatcgacaaacaatgccgcttcgaagaaatcctcgccaactttgccgcaatccccatgatcttcgacgagatcgcacaaaacaaagacaacctggcccagatcagcctgaaataccagaaccaggggaaaaaggacctgttgcaagcctcggccgaggaggacgtcaaagctataaaggacctactggaccaaaccaacaacctcctccaccgactcaaaatcttccacattagccagagcgaggacaaggccaacatattagacaaggacgagcacttctacctcgtattcgaagaatgctacttcgaacttgctaacatcgtccccctatacaataaaatccgcaattacatcacgcaaaagccatactcagacgaaaaattcaaacttaactttgagaactcaactctagcgaacggttgggataaaaacaaagaacccgacaacacggccatcctgtttataaaggacgacaagtattacctcggggtgatgaacaagaaaaataataagatcttcgacgataaggccataaaagaaaacaaaggcgaaggatataagaagatcgtgtacaaactactccccggtgccaataagatgctccctaaagtcttcttctcggctaagtcgataaagttctacaacccctccgaagatatcctccggataaggaaccactccacacataccaagaacggcaatccccaaaaggggtacgagaagttcgagtttaacatcgaggactgccgcaaattcatcgatttctacaaggaatcgatttccaagcacccggaatggaaggacttcggattccgcttctccgacacccaacgctataactcaatcgatgagttctaccgtgaagtagaaaatcaaggctacaagttgacgttcgaaaacatcagcgaatcctacatcgacagcgtagtaaaccaaggaaaactctacctgtttcaaatctacaacaaggacttttccgcttactcaaaaggcagaccaaacctccacacgctgtactggaaagcactcttcgacgaaagaaacctacaggacgtcgtctacaaacttaacggtgaagcggagctattctaccggaagcaaagcatccccaaaaagataacacacccggccaaggaagcaatcgcgaataaaaacaaagataaccccaagaaagaatctgtatttgaatatgatcttattaaagacaaacgttttaccgaagacaaattcttcttccactgcccaataaccataaacttcaagtcaagcggcgcaaacaaattcaacgacgaaatcaacctactgctaaaagaaaaggccaacgacgtccacatcctatccatagaccgaggggaacggcacctggcctactacactctggtggacggtaaaggcaacataatcaaacaagacaccttcaacatcataggaaacgaccgcatgaagaccaactatcacgacaaactagccgccatcgaaaaagacagagatagtgcccgtaaagactggaaaaagataaacaacatcaaagaaatgaaagaaggatatctctcccaagtagtccacgagatcgcaaagctagtcattgaacacaacgcgattgtagtgttcgaagacctaaacttcgggtttaaacggggacgattcaaagttgagaaacaggtataccaaaaactagagaaaatgctcatagaaaaacttaactatctggtctttaaagacaatgagttcgacaaaacaggaggcgttctcagagcataccaactgaccgcaccattcgaaacattcaagaaaatgggtaagcaaacaggaatcatatactacgtccccgcaggtttcacctcaaaaatctgccccgttacgggctttgtgaaccaactataccccaaatacgaatcagtcagcaaatcccaagagttcttctcgaagttcgacaaaatatgctacaacctggacaagggatattttgagttctcatttgattacaaaaacttcggagacaaggcggcaaaaggcaagtggaccatcgcatcctttggtagcaggctcatcaactttcgtaacagcgataagaaccataactgggacacccgcgaagtatacccaacaaaagaactggaaaagctcttgaaagactacagcatcgaatacggccacggcgaatgcatcaaggccgcaatctgtggcgaaagcgacaagaaattcttcgcaaaactaacctcggtcctaaacaccatcctacaaatgcgaaacagcaaaaccgggaccgaactagactacctcatctcaccagtagccgacgtgaacggaaatttcttcgacagcagacaagcccccaaaaacatgccacaagacgcagacgcaaacggcgcctaccacatagggctcaaaggcctgatgctgctagaccgcattaaaaacaaccaggaaggcaaaaagctgaacctagtaataaagaacgaagaatacttcgagttcgtacaaaaccgaaacaactga

SEQ ID NO: 6949 - RNA, 3756 nt, synthetic construct
  misc_feature 1..3756: note = Cpf1 variant
  source 1..3756: mol_type = other RNA
atgaaccacatgaaacaattcacgaaccaattttcactatctaaaacgctccgttttgaactaataccccaaggtaaaacgaaagaattcatagaaatcaacggtttaatcgagaaagacaatgagcgcgccgtatcctacaagaaagtcaaaaagatcatcgacgaataccacaaatacttcatagaaatggtcctttgcgactttaaactacacggccttgaaacctatgagaccatcttcaacaaaaaagaaaaagacgacaccgacaaaaaagagttcgataacatccgcaactccctacggaagcagatcgccgatgccttcgccaaaaaccccaacgacgaaattaaagaacgcttcaaaaatctctttgccaaggagctaattaaacaagacctattgaactttgttgacgacgaacaaaaagaactagtcaacgaatttaaagacttcacaacctacttcaccggcttccaccaaaaccgacgcaatatgtacgtagccgatgaaaaagccaccgcaatagcataccgactcgtcaacgaaaacctgccgaaattcatcgacaacctcaagatctacgaaaagatcaaaaaggacgcccccgagctcatatctgacctcaataagacgctcgtcgagatggaagaaatagtgcaaggcaaaaccctagacgaaatatttagcctctcgttcttcaatcaaaccttgacacaaacaggcatagaactctacaatatcgtcataggcggccggacagctgacgaaggcaagacaaaaattaagggcctcaacgagtatataaacacggactacaaccagaaacaaaccgacaagaaaaaaaagcaggcgaaattcaaacagctatacaagcagatactctccgaccgccacagcgtgagctttgtagcggaaaccttcgaaaccgacgcccaactcctagaaaacatcgagcagttctactctagcgtcctatgcaactacgaagatgacggtcacacgaccaacatcttcgaagccatcaagaatctcatcataggactcaaaactttcgatctctcgaagatctacctgagaaacgacacgtcgctaaccgacatctcgcaaaagctattcggtgactggtcgatcataagctccgccctgaacgactattatgaaaaacaaaatccgatctcgtctaaggaaaaacaagaaaaatacgacgaacgcaaagccaaatggctaaagcaggatttcaacatcgaaaccattcaaacggcactaaacgaatgcgactcagaaataataaaggaaaaaaacaacaaaaatatcgtctcagaatacttcgcaaaacttggcctcgacaaagacaacaagatcgacctcttacagaaaatacaccataactacgtcgtcatcaaggacctcctcaacgagccatacccggaaaacatcaagctcggcaaccaaaaagagcaagtgagccagatcaaagactttctcgactccattctgaacctcatccacttcctgaaaccgctaagcctcaaagacaaagacaaagaaaaagacgagctcttctactcgctattcacagccctcttcgagcacctgtcgcaaacaatcagcatctacaataaagttcgaaactatctaacacagaaggcatactccacagagaaaatcaaactaaacttcgaaaacagcactctcctgaacgggtgggacgtaaataaggaaccagtgaacacaagcgtaatcttcagaaaaaacggacttttctacctcggaatcatgtcaaaatctaacaaccgaatattcgaacgcaacgtcccggtctgcaaaaacgaggaaaccgccttcgaaaagatgaactacaaactactacccggcgcaaacaaaatgctccccaaggttttcctgagcgccaagggaatcgaatccttccagccatcagcagaaattcagagcaaataccaaaaggagacccataaaaagggcgacgccttcgtgcgcaaagacatggaaaacttaatagacttcttcaaacagagcatagccaaacacacagactggaaacacttcaaccaccaattcagcaaaacggaaacatacaacgacctctcagagttctacaaggaggtggagaaacaagggtacaagctaacgttcaccaagctcgacgaaacgtacatcaaccagctcgtcgacgagggcaaactatacttattccagatatacaacaaagacttcagccccttctcgaaaggaaaacctaacatgcatacgctgtactggaagatgctcttcgacgaacaaaaccttcaaaacgtcgtttacaagttgaacggggaggcagaggtattcttcagacaatcctcgataaaacagaccgatcgcataatccacaaggcgaatcaagctatagacaacaagaaccccctcaacaacaagaaacaatcgagctttaactacgacctcatcaaggacaaacggttcaccctcgacaagtttcagttccacgtcccaatcactctaaactttaaggccgaaggaaacgagtacctgaacactaaagtaaacgaatacctcaagtccaattccgacgtaaaaatcattgggctcgaccgaggcgaacgccatctgatatacctgactctcataaatcaaaaaggcgaactactcaaacaacaatcacttaacgtcatagccacaagccaagagcacgaaaccgactacaaaaacctactcgtcaataaagaaaacgaacgcgctaacgcaaggcaggactggaaaaccatcgaaacgatcaaagagcttaaagaaggatacctctcacaggtcgttcatcaaatcgctaccatgatggtcgacgaaaacgccatagtcgtgatggaagacctaaacgccggattcatgcgaggacgacaaaaggtggaacggcaggtgtatcagaaactagaaaaaatgcttatagagaaactcaactacttggtcttcaaaaacaacgacgtaaatgaaaccgcaggggtactaaacgcactgcagctcaccaacaagttcgaaagcttcgaaaaaatgggtaaacaaagcggtttcctgttctacgttccggcatggaatacttcgaagatcgaccccgcaactggtttcgtagacttcctgaaacccaagtacgaatcggtggaaaaagccaagctcttcttcgagaaattcgaaagcataaaatttaacgccgacaaaaactacttcgaattcgaatttgactacaagaaatttaccgaaaaagccgaaggctcccaaacaaagtggacagtctgcacacattccgacgtacgatacagatacaacccccaaacaaaggcctccgacgaagtcaacgttacaaacgaactcaaattgatattcgacaaattcaaaatcgagtataaaaacggcaaaaacctaaagaccgaactgctgctccaggacgacaagcagctcttcagcaaactcctacattacctcgccctcacactgatgctccgacagtccaaatcaggaacggacatcgacttcatactcagtccggtggcaaaaaacggcgtgttctatgacagcaggaacgctatgccaaacctccccaaagacgctgacgccaacggggcatttcacatcgccctaaaggggctatggtgcgtccaacaaattaaaaaggctgacgacctaaagaaaatcaagctggccatctcgaataaagaatggctcagtttcgtacagaacctcaagtga

SEQ ID NO: 6950 - RNA, 4173 nt, synthetic construct
  misc_feature 1..4173: note = Cpf1 variant
  source 1..4173: mol_type = other RNA
atgatcgacaacacaaaggaaaagaaagaaggatcagtattcgacggcttcacgaggaaataccaactctccaaaacactccgatttgagctacgtccaatcctcaacacccccaaaatgcttgacgacgaacaggtcataaaaaacgacgaaactagacgaaaaaagtacgaagccgtcaaaccatggtttgaccaactacaccgcgagttcatcgaggatgcactaaagtcgttcaaattcaaaaacctcgccatataccaggacacatttcagacatggcaaaaggacagaaagtcaaagcagaaaaaagacacattagtgaagatagaagtaggactacgggaagaaatagtaaggaggttcgaggaggtcgccaacatttgggtaagatcagagcaatacaaactcctcggcataaaaaaagaaggcctcggcatgctgttcgaagcgggggtctttcgcctgctaaaggaaagattcaaaaacgagaaagacaccaccgtcgatggaaacaacatcttcgacgagtggacccgatggactggctacttcaaaaaattttttgagacacgcaaaaacttctacaagtcggacgacacaagcaccgcaatcgcataccgcgtgataaaccagaacctacggcggttttgtgagaacatccaaatattcgaaaagatctcggagaaaatagaattcagcgaagtggaaaaatcgttcgacatcagctgcgcgggtatcttttcacttgcatactacaacgcgtgcctgctacagggtgggatcgacacatacaacaaaataatcgggggcgaagttgacgagaaggacaaaaaaattcccggaatcaacgagctaataaacaaatacaggcaagacaactcgggggagaaaatcccgttcctgaagcaactagataagcaaatacactccgctaaagaagcgttcatcgagtcaatagaaacaaacaaggaacttgttgggaagctgaaaacattctacgagaacgctgaggtcaaaatccaatccttcaggaacctcattgcagacatcgtcaccgactacagcggctatgatattgacaagatctacctgaccaaagaagcagtatcacataacgcctcacgatggttcgcgtctttcgaaagctttgaaagagacttattcgcggtagtagccgagaaacaaaacaaactcgtttacgaattactccgaacccacaaaaacgacagcaagatcagcgacaaggacgggaagttcagcttccccgacttcatcaaatgctcacacatcaagagagccctcgaaaagcaggaagggcggatatggaaaggggagtactacgaagacatagtcgactttgagaaaataaaagacgtcttcacgcagtttctatgcgtcttcaagtttgaactcgaacaacaattctttcgcaagacaacatcagcccaaaccggcgaacagaccaagataggctacgaaattttcgtcacaaaaataaacgagctcatcacccgcgaaaaccctgtcatagacctcgaagagaagatagcgatcaagaactttgcggacgcaaccctcctcatctaccaaatagccaaatattttgccgtagagaaacggcgcggatggctcgacaattacgacctcgatgacagattctataagtcatccgacatcggctacctaaacttctaccgggacgcgttcgaacaaatagtccgcccctacaacctattccgaaactacctgaccaagaaaccgtacaacacaaacaaatgggtactatccttcgaaaatcctaccctcgcagacggctgggataaaaacaaagagaaaaccaacgctgccgtgatactccggaaagacgggcgctactacctgggaattatcaaggaagactgtaaatccctgttcgcggaccgatacagcaaggaaatgagcgaaggaatcgaatccgggagcttccaaaagatggcgtacaagttcttccccgaagcaagcaaaatgatccccaaatgtagcacgcagacaaaaaacgtgaaagaacactttcgaaagagctcatccgactataacctgttccacgaaaaggactacaaaatttccgtcgccatcacaaaaaacatatacgaactaaacaacgtattctaccgaaaagacaacatagaagagagcttcgtaccgaagaacgacttcgaaaaaaagctgggagtaaagaaattccaacgccaatatctagagattagcagggacaacaacggatacaagcaggccctcgcacaatggattgaattctgcatccggttcctaaaagcctacaaatcaacgaccatattcgattacagccgcctccgagaggccaaagagtacgagagcctggacgccttctaccaggacatcaacgccctcacatacaatataagcttcgtacccatctccgaacagtacataaaagagaaaaacgacaatggggagctgttcctcttcgagatctacaacaaagactggtccctgggccccatggacaaaaaccgcaagcgcactaaaaaccttcacactctctacttcgagcagctgttctcgaaagaaaacgaacaggagaacttcctattccaactgaacggagaagcagaactgttcttccgtccaaagacagaagaaaaacgactagggtataaagtctgggacgccggcgagaaaaagtgggtcaaggcgaaggagaaggaagacggtgcagtgatcgacaggaaacgatacgccaaagacatcatcctcttccactgccccataacacttaaccgcgtgagcgaaagcaagaccaaacgggaaatggacgtcgaaatccgagaagtcctaagcagcacgcccggagtacacattatcggggtcgaccgaggagagaaacacctcgcctactatagcgtcatagaccaaaatggcaaaatcatcgaaaccgacacgctaaactcgatcggcaaagacggacggggcaaacctgtagaatatgccagcaaactggagaaaagagcacaagagcgcgaggcgtcccggagagactgggaagaggtcgaagcaataaaggacttgaagaagggatacatctcccaagtaataagaaacctggccgacctgataatcaaacacaacgccatcatcgttttcgaggatctgaacatgcggttcaagcagataagggggggaatcgaaaaaagtgcgtaccagcagctggaaagggcgctaatcgacaaactgtcgttcctggtcaaaaagggagaggaggacccaaaacaaaccggccacatccttcgggcctaccaactcgcagccccggtcatagccttcaaagacatgggaaagcaaacaggtcttatcttctacacgcaagccggctacacaagcaagacctgcccagaatgcggctaccggagaaatatcaaatgcctctttgaaaacatagaacaggccaagacgctcatcgaaaacctagaatccatcaactacaacaagaaggaagacgtattccagatatcctacagccttgagaagctgtcgtccaaagaccaaaagaaggagaagaaagtatccaacgaactatacgccaaaacgctcaaaaaagacatattcatattgacgacaaaaaatgcgctacgctacaagtggtacgaccgctacagcgagaaggcaaaggtcgcaaaacgaggaatagacgaatacaagggagaagtgaatgaatcagagaccaaaaaaggcgtcgtgaaagaattcaacctgacggagtacctgaaaggcctactaaaaacctacgaaatcgactatgaacatggaggtatccgagaacaaatactgtcagtcgcccgagggcgagagttctacaaggacttcctatacgccctgttcctgctaaccgagacacgacactccataagcgggcgcaatacagactacatacaatgtccagaatgcgaattcgacagcaggaaaggattcaaagacataaaagagttcaacggggacgccaacggagcatacaatatagcccgtaaaggaatcatgatcctagagaagataaaacaatttaaaaaagacaacgacggtaacctcgagaaaatgggctggggggacctaagcatatccatcgaagaatgggataagttcactcaaaaagaatga

SEQ ID NO: 6951 - RNA, 4026 nt, synthetic construct
  misc_feature 1..4026: note = Cpf1 variant
  source 1..4026: mol_type = other RNA
atgaacgcggaaaaaaaatgcgccttcaacgaattcacaaacctctacgaactatcaaagaccctcaaattcgaattgaagccagtgggcaaaacaaaagaaatcatcaagaacttccgggaggaactcgaaaagaacaaccccatccagctcgacaaggagattagcatcgccaagcaagaaataaagaaggacctcgacatactacacagagagttcgtacgccagtcgtttgagctcgccttcaaagaaaataagatcaattacgaaatattcttcgaaatctaccgtaacttcaaaaaattctcgaagaacaagaagtcagacgaatacatcgcggcaattaaaaacctcaaagaggaaaaaataaagttagtcaaaaaaatcgcggactacttcgttaaaatggaccaagaatggcgtaagtactatcccagcgaaaagaaaagcttcctcctcatgagtaacggcgtcatcaacctactaatcgacatcaacaaagaccgcatggactacagcttcatacccaaagaggtgtgcgagaagataaaaggaaaagggaaaatcgaactatacgaaaaattcaacaagcacttcggttacctttccaagtataacaccgctcgcgaaaacttctacagtgacgacgtcaagaacagcgcgagcgtagcctaccgtgccatatgcgaaaaccttgagaagttctgcgacaacaaaataaaagtagaggcagacaatttcccgaaagaaatcaaagagaaattcctcgaatacttcaacaaaatcaccgacctcagcttctacaaccgctgccttagccaaaacggaatcgaggaatatcataaattcaaggacgaaatcaaccgcagcatcaatgaactataccccaacaacagcaaaaacaaaccccaaaacataccctatctaagtaagctggataaacagatcctctcagaaaaagacaaacagagctggattgaagaaggattcatagacgaaaacaactttatcttcgaattcgaaaaatttataaaaatgaacgacaagtacattcccagcgaaaagaaattattcaacgaattcttcatattccagaataacgacgaggttctacagaaactattcctacttaaaaagacgatcaacaacttcgcaaacatttacctcgacgacccgaaaaaccttatggatctcatgccgagcaagggaaccaaaaaaagggactacttatcactactagaaattaaggaggcactgaactcatatgcagaaaaccagaacattggcgaaacccaaatcttcaagatcaaatacgacgacgtcatagataaaaccaagacgccctttgagtgcttcatgaagatttggaagtatgaatacgacctcctctacaacgagggagacgggaaaaaaaacatcgaagaggggtgggagaagatctgcgaaaaactacaaaacaaaaaggacgaatttaccggggattacggaaagtacaagaaagaaatcaaggactactgtgagatggcactgagcctatcacaacgcatcaagcacttagatatccgcatcaaaaaaagggacggaagcgaggatgccgacaacaacctcttcgaaggcgtagagaaactggacgaattctacgacagattattcgaaattgtagatgaacacaacgcgtaccagtaccaccacgagtttcaagcgttcctaacaaaaaaaccatacaagacagacaagttcaaactcagcttcgacaatccacaactgctcaagggctgggacctaaacaaggaacccgactacttcggcgcactgctagttaaaaacgagaaatacttcttagccgtattccacaagcagtacgccaacgaaatattccgacagaaaaacaagaattcaaccgtgaagatcaaggaggcctacgacgtcttcaacggaaactattacaaaaaggtagaactaaagcaaatacccaaactgttcatgaaccttcccaggatctgcttcgccaaatcaaaccaagaggagttcggcttaactattgagctagagaaaatcaaaagcgaatttgacaagtttcaaaaacttaaaaaggaacgccaagacaacaatctcaaattcgatcaagaaaaattcatcaagctgctggcctattaccgacactgcctggagatacgcgaggattggaaagtcttcaaatacaacttcaagccactttacaaatactcaaacttaggtgagttttacagggatctggagaaggatacatacaatttggacctggtccgtgtcaacagcgagtacgtagaaaagaaaagaaatgaaggcaaactgtacttgtttgaagtctacaataaagatttctcggacaagtcaatcggccgaaagaacatccacagcgactactttaaaagtctgttcctccccgacaacctgacgaacaaaaagatcgccttagcggcagacgctgagatcttcttccgcgagaagagcctcaagaacaaagacgaaatcataacgcaaaagaacaaaatcaaaatagacaagaacaaccacaaaggagaaaaagcatatagcaaaaacaggtatacggacgataaaatcatcctacacctcccaatcaacctaaacttcggcgaaaacaaaaaccataaagacttcaactatgagatcaatgactccctgctaaagaacaaccgcgacatcaaaataataggcatcgacagaggtgaaaaatacctgctctactacagcgtcatcgaccaaaagggcgacatcaaggaaatgggggacttcaacgtcgtgaacggggtggactactatagcaaactagtggcgtacgaggagaagcgaaaacaggcacgccttgactggggggatatacagtccataaaagaacttaaggaaggctatattagccacgtcatacatgaaatatgcgacctaatcaagaaatacaatgccatcgtggtactagaggacctcagcatgggcttcaaaaggggccgcttcttccgagaaagacaggtctaccaaaaattcgagctcgcgctattccgcaaattaaactactgggtagacaaaaacaaggaagagggggagaaagggtctgccctgagcgcctggcagctcaccccaaacgaaaaagacttcaaagtatcccaactggaaaaagcacggcaactgggcatactgttctacaccgcagctggctatacctcgaagacctgcccggactgcggatttaggaaaaatataaccctaaagtacgtgaatgacaagcagctaaaagaggacctgggcaaactcaagatcaacttcgtcgaagaccacttcaagatcaagtacaacctattggacttcgagaaaaacaaaaaaagcgaaaaggcgaaagacacggtactgcctaaagaagaacgcaagatcagcttcgtggccaactccaaagtcatccgaatcagatggcacgatatcaaaacgaaactggcaaagcgtgaactagacggcgaaaagatcatcaagaagttcccaaaaggcgtcataaaagagtacgacattaacatatgcctaaagcgaataatcggagacaaaatcgactttagcaaagattccattaccgaacagcttataaacggccggttcggcaaagacttctactgggaactgatgtactttctgaatttgatcctagagatccgcaacgtagtatcagagacagaaatcgactacatccaatgccccgtctgcggattccacagtgatgacggcttccgaggaaataaattcaacggggacgcaaacggcgcctacaacattgcacgaaaaggcaggctcatcctcgaaaaaattaaccagcacaaaaacctcaaggaattaaagactggcgacctcagcgtcaacatcgtcgagtgggacaaggctgtaaacaactgggacaaattcgtgcaaggcgacaacacagaaagcaaaaacatagaaatcccagcgaaggaagagatgatctccgtggaggtccgggaaagctga

SEQ ID NO: 6952 - RNA, 4107 nt, synthetic construct
  misc_feature 1..4107: note = Cpf1 variant
  source 1..4107: mol_type = other RNA
atgaagaaagaaaaagagtttaagagcttcggagacttcaccaacctgtacgaaataagtaaaacactacggttcgaactaaaaccggtagagaatacacaaaccatgctcgatgaagcagacgtcttcggaaaagacaaagtcatcaaagacaagtacacaaaaacgaaaccgttcatcgataaactacacagggagttcgtcgacgaaagcctcaaggacgtcagcctatctggactgaaaaagtacagcgaagtcctcgaaaactggaagaaaaacaaaaaggacaaagacatcgtaaaagaactcaagaaagaagaagaaaggttgcggaaagaagttgttgagttcttcgataacaccgcaaagaaatgggccaacgaaaaatacaaagagctcggactgaagaagaaagacatcggtatactcttcgaagaaagtgttttcgacctgctgaaagaaaaatacggcgaggagcaagacagctttctcaaagaggaaaagggcgatttcctcaagaatgaaaaaggggagaaggtatccatcttcgacgaatggaaagggttcgtaggctacttcacaaagttccaagaaacacgaaagaatttttataagaacgacggcacagaaaccgcccttgcgacacgaatcatagaccaaaacctcaagagattctgcgataacatcgacgacttcaaaaagatcaaaaacaagatcgacttcagcgaagtagagaagaacttcaacaaaacagccgatgtgttctccctcgatttctacaaccaatgcttgctccagaaaggcatcgacagctataacgagttcataggagggaagaccctagaaaacggaaagaaactaaaaggcgtaaacgaactggttaacgagtaccgccagaaaaacaaaaacgaaaaagtcagcttcctaaagctcctagacaagcaaatcctctccgagaaagaaaaactctctttcggcatagaaaacgacgaacaacttctcgtagtactaaacagcttctacgagacagcggaagagaaaaccaagatactacgcaccctcttcggagactttgtggagcacaacgagaactacgatctcgacaaaacatatatcagcaaagtagcattcaacacaatatctcacaagtggacgaacgagacacacaaattcgaggaactactctacggggcaatgaaagaggataaaccgattggcctcaactacgataaaaaggaagactcatacaaattcccagactttatcgccctaggctacctcaagaaatgtctcaacaacctggactgcgataccaaattctggaaagaaaagtactatgaaaacaacgccgacaaaaaggacaaagacaaaggattcctcaccggtggacaaaacgcatgggaccagttcctgcaaatattcatctttgaatttaaccaactgttcaactcggaggcctttgataacaaaggtaaagaaatcaaaatcggttacgataattttagaaaggacttcgaggaaattatcaatcagaaggactttaaaaatgacgagaacctgaaaatcgcaatcaaaaacttcgcagactcggtcctatggatctaccagatggccaaatacttcgcaatcgaaaagaaacgcgggtgggacgacgacttcgagctgtccgaattttacaccaacccgtccaacgggtacagccttttctacgatcgagcgtacgaggagattgttcaaaaatataacgacctgcgaaactacctaacgaagaaaccctacaaggaagacaaatggaaactcaacttcgaaaacccaacgctggcaaacggatttgacaagaacaaagaatcagacaacagcactgtcatcctacgtaaaaagcgcaaatactacttagggctcatgaagaaaggcaataacaaaattttcgaagatcggaacaaagcagagttcatacgcaatatcgaaagcggtgcatacgaaaagatggcatacaagtacctgccagacgtagctaaaatgatcccaaagtgctccacgcagctgaacgaggctaagaatcactttcgtaactcggccgacgacctcgaaataaagaaatctttctcgaaccccctaaaaatcacgaaacgaatattcgatctcaacaacatacagtacgacaaaaccaacgtatcgaagaaaatcagcggagacaacaaaggcatcaaaatcttccagaaagaatactacaaaatctccggtgacttcgacgtgtataaaagcgcgctcaacgattggatcgatttctgcaaagacttcctgagcaaatacgactcgaccaaagacttcgacttctcgatcctgcgcaagaccaaagactacaagtccctagacgagttctacgtcgacgtcgcgaagatcacctataagatcagcttcacgcctgtgagcgaatcttacatcgatcagaagaacaagaacggagaactgtatcttttcgaaatttacaaccaagacttcgccaagggcaagatgggagctaagaacctacacacactatacttcgaaaatgtattctcccccgaaaacattagcaaaaacttcccaatcaagctgaacggcaacgccgaactcttcttccgacccaagagcatagaaagcaaaaaggagaaacgaaacttcgtgagggagatcgtaaacaagaaacgctacagcgaagacaaaatattctttcactgcccgattaccctcaaccgggagaccggtagcatctaccgctttaataactacgtcaacaacttcctatcagaaaacaacatcaacataataggagtcgatagaggggagaaacacctcgcctactactcagtaatagacaaaaacggcgtaaaaataggaggaggcagcttcaacgagattaacaaggtcgactacgccaagaaactggaagaacgggcaggagagcgggagcagtcacgcaaggattggcaggtagtagaagggatcaaagacctcaaaaagggttacatctcgcaagtcgtccgggaactagcggacctagccatcaaacacaacgcgatcatagtcctagaagacctaaacatgcggttcaaacaaatcagagggggaatcgagaaaagcatctaccaacaactagaaaaagcgctaatcgacaagctgagcttcctcgtggagaagggcgaaaaagacccgaaccaggccggccacatactaaaggcataccaactagcggcgcccttcacctctttcaaagacatgggcaaacaaaccggtatcgtcttctacacgcaagcgagctataccagcaaaacctgtccaaactgcggcttccggaagaacaataataaattctacttcgaaaacaacatcgggaaggcccaggacgccctcaagaaacttaaaactttcgaatacgactcagaaaataaatgcttcggtctaagttactgcctcagcgacttcgccaacaaggaggaggtcgagaaaaataagaataagaaaaggaacaacgcgccgtattcagacattgagaagaaagactgcttcgaactcagcacaaaagatgccgtacgataccgatggcacgacaaaaacaccgaacgaggaaaaacatttttcgaaggcgaatcagtctatgaagaaaaggaggaaaaagaaataggccagacgaagaggggcctcgtcaaagaatacgacattagtaaatgcctcataggactcttcgaaaagacgggactagactacaagcaaaacctcctcgataagatcaactccggcaaattcgacggcacattttacaaaaacctattcaactatcttaacttactgttcgagatcagaaactccatcagcggaaccgaaatcgactacatctcatgcccagagtgccaattccacacagataaaagcaagaccattaaaaacggagacgacaacgggtcctacaacatagcgaggaaaggcatgataatacttgacaaaataaaacagttcaaaaaggagaacggaagcctcgacaagatggggtggggagaactctttatcgacctggaagaatgggacaaattcgctcagaaaaagaacaataacataattgataaatga

SEQ ID NO: 6953 - RNA, 4149 nt, synthetic construct
  misc_feature 1..4149: note = Cpf1 variant
  source 1..4149: mol_type = other RNA
atgtccaaaaataacgtatgggacaaattcaccaaccagtactcgctgagtaagaccctccggttcgaactaaagcccgtgggcaagacgagggaaaagatgaacgaacagttaaagtacgacaagcaattacaaacgttcctaaaggaccaagaaatcgaggacgcatatcaatacctaaagccattctttgacaaactccacaaagagttcatcaccgattccctagactccgataccacgaagaaaattgacttcagcgactacctcatcgactaccgtgacaaaaaggacctcaccaagaaagaagacagcctgagaaagaacataggcgaggtgttcgtcaaagccggtgaccggtggaagaaagagaaataccccaaatacgagtggaaaaagggtagtaatgtggcgaacggatccggaatcctactcacacaggacgtactgatgctgataaaagacctcaaccccaacgaccagaaaataaagaaaatgatagaagaaacgttcaaaggattcttcacgtacttctccggctttaacctaaaccgggaaaactactataccaccaaagtagagaaagccaccgccgtcgccactagaatcgtgcacgacaacctcccgaagttctgcgacaacctcgtccaattcgagtgcatcataaagaagaagaaaaacggcgaggtagaccgcatcgagcgaaaatcggaatacctcaacgcgtatcaatacctcaaatcaaaagggcgcaccacacaaatcaaagatgcagaatcagggaaaatgatcgaggccgaagtcatcaatgaaaacatgttctccatcagctacttctccgcctgcttgtcccaatccggcatagaggagtacaataggactattggacactacaacttgctcataaacctctacaaccaagcgaaagagggcgaggaaaaagacctgaagaaatccgagaaaaagtttaaacggctgcccatcttcaagacactttacaaacagatcggctgcggcgaaaaagaacccttattcttcagcctaacacacgacacaaaattgcaagtacaagagaacaaagagaactacaagaaaccatacagcgtagagcaaatcctcgagcaagccaaactggcaggagacaaatacttcaagggcaaatccaacgatggcatattaaacacgataccagagttctccgactacatattacaaaaagagagttacggaggtgtctactggtccaaggtagcgatcaacaccatctcaaaccgctacttcgagaactggcacacactcaaggacgccctaatcgacgcgaaagtcttcgaaaaggggaagaaaggtgacgaggaggacgtgaaaataccagagagcatcgaactgcaaggcttcttcgacgtactagacacccaagaagggtggaaaagcgaaggaatattcttcaagaaaagcctgaccgaggaactaaagaacaaggaagcggacaccaaaaacaagaaacggcgagagatcgtaaaggaagcgaaaagaccgtcccaggctctacttgccctactgttcgacgacatacaggagcatgcgaacctattcctcaaccagtcagacgaaatattaaaactggagaaatactcagagaaagaatccaaagagaaaatcaagcaatggatggactccgcgctcgccgtcaatcgaatactaaagtacttcttcgttaaggaatcaaaggcaaaaggcgaacagatcgaccccatcattagtgaagccttaaaagtactcttcaactccgaggacgccacatggttcaaatggtacgacgccctccggaactacctcacaaagaaaccccaagacgacgtcaaggaaaacaagttaaaactcaacttcgaaaacagcaccttagccggcgggtgggacataaacaaagaatccgacaactactgcgtcatactacaagaccaaaagggcaagcagcacctcggcataattgccaagaaggagaagcaacgcggctacaacaaaatcttcgagcgaacgcccgaaaatcccctatataaaatagactccggcgaggtgtggcagaaaatggaatacaaacaaatcgccgtgcccaccggaataggagggttcgtaagaaaatgtttcaacaccgcccaacaatacgggtggaaatgcccggacaactgtctaaacagcgaaggaaaaataatcatcaaaaacgacgaggcaaaagaaaacttagaagcaatcatagactgctataaagacttctttacaaagtacgagaaagacggattcaagtacaaaaacttcaacttcaacttcaaagaatctgaagagtacgaggagctgaactcattcttctccgacgtggaaagacagggatacaagctaggattcataacggtcaacaaaacaatcatagacaagtgggtcgaagacggcacgatctacctattcgaaatcaaaaaccaagataccaacgacggaaagaaagatgggcacaaaaacaaccttcacaccatctactggaaagccctcttcgaagacgtagggaacaaacccaaactcaacggaggagcagaactattttaccgtaaggccctactgaaggacaaacaagagaagattgaagacaactacgggaaggaaatcatcaaaaacttcaggttctcaaaagagaagtttctgttccactgcccgataaaactaaactataaagcaaaatcgtattcgcacccgaaatacgcactgcccgagatcaacaaacagacaaacgagttctttattaccatctcggacatctgcttcctgggaatcgatagaggggaaaagcacctagcctactactccctggtaaaccagaaagaggaaatcatagatcaaggcaccctcaacatgccattcgtcgacaaagacggcaaaccgcggagcatcaagaaggaaaaattcaggttcgacgcgaaggtggacaaatgggtctcggaggaaatggactgctggaactacaatgatctcctcgacgccatggcgtcaaacagggacatggcgcggaaaaactggcaaaccatcggtaccatcaaagaacttaaaaacggctacatctcacaagtcgtgcgcaaaatagtcgatctcgcgatcgacaaaaaccggggaatacccagcttcatcgtactggagaatctcaacgcaggattcatgcgaggccgacagaaaatcgagaaaagcgtttaccaaaagctagaactcgcactagccaaaaagctcaacttcgtagtcgataaaacggtccaaaacggggaaatagggtcagtcaccaacgcactgcaactcacaccgcccgtaacaaacttccaaaatatcgaaaatcgcaagcaagtgggaataatgctgtacacccgagcagactacacaagccaaacagaccccgtcacgggctggcgcaaaagcatttacctaaagaaaggaagcgaagaatatatcaaatcccagataatggattccttcgatgacttcggtttcgatgggaagaactactactttaaatacacggtcgacttaatagacccaataaagaaaacaagcgagaagaaattcaagaaacagtggacactatatagcggcattaacggcaaatcgctggacaggttcagaggagaacgctcctcagacaaaaacgtctggatcaaaaccctccaagacatcaaaaccaccctagacgccgtgttcatagggttcgacctgcagcactctcttagaagccaaatcatcaacgacggaattatgcccaagaaaatagagaactctcagttcaccggctgggaaagccttaggttcgccatcgagatgatccagcaaatacggaacataggcgtggaaaagggagacgaagactttatactatcgccagtacgagacaagaacgaaaaccacttcgacagccgaaaggccaaggaaaacgagcccaacagcggcgacgccaacggcgcgtacaatatcgcaaggaaaggcatcattatgaatgagcatatcaagaaggacctaatccccttcatacaagacaaggaatgggacgcctggctcgcaggacgcgaagtctgggacaaatggcttatagaaaacaaagactccctaatctacaaaaagtga

SEQ ID NO: 6954 - RNA, 4203 nt, synthetic construct
  misc_feature 1..4203: note = Cas9 variant mRNA product
  source 1..4203: mol_type = other RNA
atggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaatga

SEQ ID NO: 6955 - RNA, 4986 nt, synthetic construct
  misc_feature 1..4986: note = Cas9 variant mRNA product
  source 1..4986: mol_type = other RNA
atggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaatga

SEQ ID NO: 6956 - RNA, 3258 nt, synthetic construct
  misc_feature 1..3258: note = Cas9 variant mRNA product
  source 1..3258: mol_type = other RNA
atggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaatga

SEQ ID NO: 6957 - RNA, 4326 nt, synthetic construct
  misc_feature 1..4326: note = Cas9 variant mRNA product
  source 1..4326: mol_type = other RNA
atggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaatga

SEQ ID NO: 6958 - RNA, 3402 nt, synthetic construct
  misc_feature 1..3402: note = Cas9 variant mRNA product
  source 1..3402: mol_type = other RNA
atggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaatga

SEQ ID NO: 6959 - RNA, 4263 nt, synthetic construct
  misc_feature 1..4263: note = Cas9 variant mRNA product
  source 1..4263: mol_type = other RNA
atggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaatga

SEQ ID NO: 6960 - RNA, 3345 nt, synthetic construct
  misc_feature 1..3345: note = Cas9 variant mRNA product
  source 1..3345: mol_type = other RNA
atggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaatga

SEQ ID NO: 6961 - RNA, 4101 nt, synthetic construct
  misc_feature 1..4101: note = Cas9 variant mRNA product
  source 1..4101: mol_type = other RNA
atggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaatga

SEQ ID NO: 6962 - RNA, 4134 nt, synthetic construct
  misc_feature 1..4134: note = Cas9 variant mRNA product
  source 1..4134: mol_type = other RNA
atggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtga

SEQ ID NO: 6963 - RNA, 3267 nt, synthetic construct
  misc_feature 1..3267: note = Cas9 variant mRNA product
  source 1..3267: mol_type = other RNA
atggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaatga

SEQ ID NO: 6964 - RNA, 3345 nt, synthetic construct
  misc_feature 1..3345: note = Cas9 variant mRNA product
  source 1..3345: mol_type = other RNA
atggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaatga

SEQ ID NO: 6965 - RNA, 3351 nt, synthetic construct
  misc_feature 1..3351: note = Cas9 variant mRNA product
  source 1..3351: mol_type = other RNA
atggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaatga

SEQ ID NO: 6966 - RNA, 3051 nt, synthetic construct
  misc_feature 1..3051: note = Cas9 variant mRNA product
  source 1..3051: mol_type = other RNA
atggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaatga

SEQ ID NO: 6967 - RNA, 3462 nt, synthetic construct
  misc_feature 1..3462: note = Cas9 variant mRNA product
  source 1..3462: mol_type = other RNA
atggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaatga

SEQ ID NO: 6968 - RNA, 4020 nt, synthetic construct
  misc_feature 1..4020: note = Cpf1 variant mRNA product
  source 1..4020: mol_type = other RNA
atggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaatga

SEQ ID NO: 6969 - RNA, 3999 nt, synthetic construct
  misc_feature 1..3999: note = Cpf1 variant mRNA product
  source 1..3999: mol_type = other RNA
atggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaatga

SEQ ID NO: 6970 - RNA, 4716 nt, synthetic construct
  misc_feature 1..4716: note = Cas9 variant mRNA product
  source 1..4716: mol_type = other RNA
gggagagtcccgcagtcggcgtccagcggctctgcttgttcgtgtgtgtgtcgttgcaggccttattcaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6971 - RNA, 5499 nt, synthetic construct
  misc_feature 1..5499: note = Cas9 variant mRNA product
  source 1..5499: mol_type = other RNA
gggagagtcccgcagtcggcgtccagcggctctgcttgttcgtgtgtgtgtcgttgcaggccttattcaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6972 - RNA, 3771 nt, synthetic construct
  misc_feature 1..3771: note = Cas9 variant mRNA product
  source 1..3771: mol_type = other RNA
gggagagtcccgcagtcggcgtccagcggctctgcttgttcgtgtgtgtgtcgttgcaggccttattcaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6973 - RNA, 4839 nt, synthetic construct
  misc_feature 1..4839: note = Cas9 variant mRNA product
  source 1..4839: mol_type = other RNA
gggagagtcccgcagtcggcgtccagcggctctgcttgttcgtgtgtgtgtcgttgcaggccttattcaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6974 - RNA, 3915 nt, synthetic construct
  misc_feature 1..3915: note = Cas9 variant mRNA product
  source 1..3915: mol_type = other RNA
gggagagtcccgcagtcggcgtccagcggctctgcttgttcgtgtgtgtgtcgttgcaggccttattcaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6975 - RNA, 4776 nt, synthetic construct
  misc_feature 1..4776: note = Cas9 variant mRNA product
  source 1..4776: mol_type = other RNA
gggagagtcccgcagtcggcgtccagcggctctgcttgttcgtgtgtgtgtcgttgcaggccttattcaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6976 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6977 - RNA, 4614 nt, synthetic construct
  misc_feature 1..4614: note = Cas9 variant mRNA product
  source 1..4614: mol_type = other RNA
gggagagtcccgcagtcggcgtccagcggctctgcttgttcgtgtgtgtgtcgttgcaggccttattcaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6978 - RNA, 4647 nt, synthetic construct
  misc_feature 1..4647: note = Cas9 variant mRNA product
  source 1..4647: mol_type = other RNA
gggagagtcccgcagtcggcgtccagcggctctgcttgttcgtgtgtgtgtcgttgcaggccttattcaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6979 - RNA, 3780 nt, synthetic construct
  misc_feature 1..3780: note = Cas9 variant mRNA product
  source 1..3780: mol_type = other RNA
gggagagtcccgcagtcggcgtccagcggctctgcttgttcgtgtgtgtgtcgttgcaggccttattcaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6980 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6981 - RNA, 3864 nt, synthetic construct
  misc_feature 1..3864: note = Cas9 variant mRNA product
  source 1..3864: mol_type = other RNA
gggagagtcccgcagtcggcgtccagcggctctgcttgttcgtgtgtgtgtcgttgcaggccttattcaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6982 - RNA, 3564 nt, synthetic construct
  misc_feature 1..3564: note = Cas9 variant mRNA product
  source 1..3564: mol_type = other RNA
gggagagtcccgcagtcggcgtccagcggctctgcttgttcgtgtgtgtgtcgttgcaggccttattcaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6983 - RNA, 3975 nt, synthetic construct
  misc_feature 1..3975: note = Cas9 variant mRNA product
  source 1..3975: mol_type = other RNA
gggagagtcccgcagtcggcgtccagcggctctgcttgttcgtgtgtgtgtcgttgcaggccttattcaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6984 - RNA, 4533 nt, synthetic construct
  misc_feature 1..4533: note = Cpf1 variant mRNA product
  source 1..4533: mol_type = other RNA
gggagagtcccgcagtcggcgtccagcggctctgcttgttcgtgtgtgtgtcgttgcaggccttattcaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6985 - RNA, 4512 nt, synthetic construct
  misc_feature 1..4512: note = Cpf1 variant mRNA product
  source 1..4512: mol_type = other RNA
gggagagtcccgcagtcggcgtccagcggctctgcttgttcgtgtgtgtgtcgttgcaggccttattcaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6986 - RNA, 4813 nt, synthetic construct
  misc_feature 1..4813: note = Cas9 variant mRNA product
  source 1..4813: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6987 - RNA, 5596 nt, synthetic construct
  misc_feature 1..5596: note = Cas9 variant mRNA product
  source 1..5596: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6988 - RNA, 3868 nt, synthetic construct
  misc_feature 1..3868: note = Cas9 variant mRNA product
  source 1..3868: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6989 - RNA, 4936 nt, synthetic construct
  misc_feature 1..4936: note = Cas9 variant mRNA product
  source 1..4936: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6990 - RNA, 4012 nt, synthetic construct
  misc_feature 1..4012: note = Cas9 variant mRNA product
  source 1..4012: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6991 - RNA, 4873 nt, synthetic construct
  misc_feature 1..4873: note = Cas9 variant mRNA product
  source 1..4873: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6992 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6993 - RNA, 4711 nt, synthetic construct
  misc_feature 1..4711: note = Cas9 variant mRNA product
  source 1..4711: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6994 - RNA, 4744 nt, synthetic construct
  misc_feature 1..4744: note = Cas9 variant mRNA product
  source 1..4744: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6995 - RNA, 3877 nt, synthetic construct
  misc_feature 1..3877: note = Cas9 variant mRNA product
  source 1..3877: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6996 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6997 - RNA, 3961 nt, synthetic construct
  misc_feature 1..3961: note = Cas9 variant mRNA product
  source 1..3961: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6998 - RNA, 3661 nt, synthetic construct
  misc_feature 1..3661: note = Cas9 variant mRNA product
  source 1..3661: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 6999 - RNA, 4072 nt, synthetic construct
  misc_feature 1..4072: note = Cas9 variant mRNA product
  source 1..4072: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 7000 - RNA, 4630 nt, synthetic construct
  misc_feature 1..4630: note = Cpf1 variant mRNA product
  source 1..4630: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 7001 - RNA, 4609 nt, synthetic construct
  misc_feature 1..4609: note = Cpf1 variant mRNA product
  source 1..4609: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 7002 - RNA, 4497 nt, synthetic construct
  misc_feature 1..4497: note = Cas9 variant mRNA product
  source 1..4497: mol_type = other RNA
gggagagcggctcggccattttgtcccagtcagtccggaggctgcggctgcagaagtaccgcctgcggagtaactgcaaagaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7003 - RNA, 5280 nt, synthetic construct
  misc_feature 1..5280: note = Cas9 variant mRNA product
  source 1..5280: mol_type = other RNA
gggagagcggctcggccattttgtcccagtcagtccggaggctgcggctgcagaagtaccgcctgcggagtaactgcaaagaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7004 - RNA, 3552 nt, synthetic construct
  misc_feature 1..3552: note = Cas9 variant mRNA product
  source 1..3552: mol_type = other RNA
gggagagcggctcggccattttgtcccagtcagtccggaggctgcggctgcagaagtaccgcctgcggagtaactgcaaagaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7005 - RNA, 4620 nt, synthetic construct
  misc_feature 1..4620: note = Cas9 variant mRNA product
  source 1..4620: mol_type = other RNA
gggagagcggctcggccattttgtcccagtcagtccggaggctgcggctgcagaagtaccgcctgcggagtaactgcaaagaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7006 - RNA, 3696 nt, synthetic construct
  misc_feature 1..3696: note = Cas9 variant mRNA product
  source 1..3696: mol_type = other RNA
gggagagcggctcggccattttgtcccagtcagtccggaggctgcggctgcagaagtaccgcctgcggagtaactgcaaagaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7007 - RNA, 4557 nt, synthetic construct
  misc_feature 1..4557: note = Cas9 variant mRNA product
  source 1..4557: mol_type = other RNA
gggagagcggctcggccattttgtcccagtcagtccggaggctgcggctgcagaagtaccgcctgcggagtaactgcaaagaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7008 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7009 - RNA, 4395 nt, synthetic construct
  misc_feature 1..4395: note = Cas9 variant mRNA product
  source 1..4395: mol_type = other RNA
gggagagcggctcggccattttgtcccagtcagtccggaggctgcggctgcagaagtaccgcctgcggagtaactgcaaagaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7010 - RNA, 4428 nt, synthetic construct
  misc_feature 1..4428: note = Cas9 variant mRNA product
  source 1..4428: mol_type = other RNA
gggagagcggctcggccattttgtcccagtcagtccggaggctgcggctgcagaagtaccgcctgcggagtaactgcaaagaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7011 - RNA, 3561 nt, synthetic construct
  misc_feature 1..3561: note = Cas9 variant mRNA product
  source 1..3561: mol_type = other RNA
gggagagcggctcggccattttgtcccagtcagtccggaggctgcggctgcagaagtaccgcctgcggagtaactgcaaagaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7012 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7013 - RNA, 3645 nt, synthetic construct
  misc_feature 1..3645: note = Cas9 variant mRNA product
  source 1..3645: mol_type = other RNA
gggagagcggctcggccattttgtcccagtcagtccggaggctgcggctgcagaagtaccgcctgcggagtaactgcaaagaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7014 - RNA, 3345 nt, synthetic construct
  misc_feature 1..3345: note = Cas9 variant mRNA product
  source 1..3345: mol_type = other RNA
gggagagcggctcggccattttgtcccagtcagtccggaggctgcggctgcagaagtaccgcctgcggagtaactgcaaagaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7015 - RNA, 3756 nt, synthetic construct
  misc_feature 1..3756: note = Cas9 variant mRNA product
  source 1..3756: mol_type = other RNA
gggagagcggctcggccattttgtcccagtcagtccggaggctgcggctgcagaagtaccgcctgcggagtaactgcaaagaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7016 - RNA, 4314 nt, synthetic construct
  misc_feature 1..4314: note = Cpf1 variant mRNA product
  source 1..4314: mol_type = other RNA
gggagagcggctcggccattttgtcccagtcagtccggaggctgcggctgcagaagtaccgcctgcggagtaactgcaaagaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7017 - RNA, 4293 nt, synthetic construct
  misc_feature 1..4293: note = Cpf1 variant mRNA product
  source 1..4293: mol_type = other RNA
gggagagcggctcggccattttgtcccagtcagtccggaggctgcggctgcagaagtaccgcctgcggagtaactgcaaagaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7018 - RNA, 4439 nt, synthetic construct
  misc_feature 1..4439: note = Cas9 variant mRNA product
  source 1..4439: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7019 - RNA, 5222 nt, synthetic construct
  misc_feature 1..5222: note = Cas9 variant mRNA product
  source 1..5222: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7020 - RNA, 3494 nt, synthetic construct
  misc_feature 1..3494: note = Cas9 variant mRNA product
  source 1..3494: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7021 - RNA, 4562 nt, synthetic construct
  misc_feature 1..4562: note = Cas9 variant mRNA product
  source 1..4562: mol_type = other RNA
gggagagtccgctcagccaggttgcagaagcggcttagcgtgtgtcctaatcttctctctgcgtgtaggtaggcctgtgccgcaaacaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7022 - RNA, 3638 nt, synthetic construct
  misc_feature 1..3638: note = Cas9 variant mRNA product
  source 1..3638: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7023 - RNA, 4499 nt, synthetic construct
  misc_feature 1..4499: note = Cas9 variant mRNA product
  source 1..4499: mol_type = other RNA
gggagagtccgctcagccaggttgcagaagcggcttagcgtgtgtcctaatcttctctctgcgtgtaggtaggcctgtgccgcaaacaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7024 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7025 - RNA, 4337 nt, synthetic construct
  misc_feature 1..4337: note = Cas9 variant mRNA product
  source 1..4337: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7026 - RNA, 4370 nt, synthetic construct
  misc_feature 1..4370: note = Cas9 variant mRNA product
  source 1..4370: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7027 - RNA, 3503 nt, synthetic construct
  misc_feature 1..3503: note = Cas9 variant mRNA product
  source 1..3503: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7028 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7029 - RNA, 3587 nt, synthetic construct
  misc_feature 1..3587: note = Cas9 variant mRNA product
  source 1..3587: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7030 - RNA, 3287 nt, synthetic construct
  misc_feature 1..3287: note = Cas9 variant mRNA product
  source 1..3287: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7031 - RNA, 3698 nt, synthetic construct
  misc_feature 1..3698: note = Cas9 variant mRNA product
  source 1..3698: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7032 - RNA, 4256 nt, synthetic construct
  misc_feature 1..4256: note = Cpf1 variant mRNA product
  source 1..4256: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7033 - RNA, 4235 nt, synthetic construct
  misc_feature 1..4235: note = Cpf1 variant mRNA product
  source 1..4235: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7034 - RNA, 4420 nt, synthetic construct
  misc_feature 1..4420: note = Cas9 variant mRNA product
  source 1..4420: mol_type = other RNA
gggagagtcccgcagtcggcgtccagcggctctgcttgttcgtgtgtgtgtcgttgcaggccttattcaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7035 - RNA, 5203 nt, synthetic construct
  misc_feature 1..5203: note = Cas9 variant mRNA product
  source 1..5203: mol_type = other RNA
gggagagtcccgcagtcggcgtccagcggctctgcttgttcgtgtgtgtgtcgttgcaggccttattcaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7036 - RNA, 3475 nt, synthetic construct
  misc_feature 1..3475: note = Cas9 variant mRNA product
  source 1..3475: mol_type = other RNA
gggagagtcccgcagtcggcgtccagcggctctgcttgttcgtgtgtgtgtcgttgcaggccttattcaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7037 - RNA, 4543 nt, synthetic construct
  misc_feature 1..4543: note = Cas9 variant mRNA product
  source 1..4543: mol_type = other RNA
gggagagtcccgcagtcggcgtccagcggctctgcttgttcgtgtgtgtgtcgttgcaggccttattcaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7038 - RNA, 3619 nt, synthetic construct
  misc_feature 1..3619: note = Cas9 variant mRNA product
  source 1..3619: mol_type = other RNA
gggagagtcccgcagtcggcgtccagcggctctgcttgttcgtgtgtgtgtcgttgcaggccttattcaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7039 - RNA, 4480 nt, synthetic construct
  misc_feature 1..4480: note = Cas9 variant mRNA product
  source 1..4480: mol_type = other RNA
gggagagtcccgcagtcggcgtccagcggctctgcttgttcgtgtgtgtgtcgttgcaggccttattcaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7040 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7041 - RNA, 4318 nt, synthetic construct
  misc_feature 1..4318: note = Cas9 variant mRNA product
  source 1..4318: mol_type = other RNA
gggagagtcccgcagtcggcgtccagcggctctgcttgttcgtgtgtgtgtcgttgcaggccttattcaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7042 - RNA, 4351 nt, synthetic construct
  misc_feature 1..4351: note = Cas9 variant mRNA product
  source 1..4351: mol_type = other RNA
gggagagtcccgcagtcggcgtccagcggctctgcttgttcgtgtgtgtgtcgttgcaggccttattcaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7043 - RNA, 3484 nt, synthetic construct
  misc_feature 1..3484: note = Cas9 variant mRNA product
  source 1..3484: mol_type = other RNA
gggagagtcccgcagtcggcgtccagcggctctgcttgttcgtgtgtgtgtcgttgcaggccttattcaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7044 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7045 - RNA, 3568 nt, synthetic construct
  misc_feature 1..3568: note = Cas9 variant mRNA product
  source 1..3568: mol_type = other RNA
gggagagtcccgcagtcggcgtccagcggctctgcttgttcgtgtgtgtgtcgttgcaggccttattcaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7046 - RNA, 3268 nt, synthetic construct
  misc_feature 1..3268: note = Cas9 variant mRNA product
  source 1..3268: mol_type = other RNA
gggagagtcccgcagtcggcgtccagcggctctgcttgttcgtgtgtgtgtcgttgcaggccttattcaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7047 - RNA, 3679 nt, synthetic construct
  misc_feature 1..3679: note = Cas9 variant mRNA product
  source 1..3679: mol_type = other RNA
gggagagtcccgcagtcggcgtccagcggctctgcttgttcgtgtgtgtgtcgttgcaggccttattcaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7048 - RNA, 4237 nt, synthetic construct
  misc_feature 1..4237: note = Cpf1 variant mRNA product
  source 1..4237: mol_type = other RNA
gggagagtcccgcagtcggcgtccagcggctctgcttgttcgtgtgtgtgtcgttgcaggccttattcaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7049 - RNA, 4216 nt, synthetic construct
  misc_feature 1..4216: note = Cpf1 variant mRNA product
  source 1..4216: mol_type = other RNA
gggagagtcccgcagtcggcgtccagcggctctgcttgttcgtgtgtgtgtcgttgcaggccttattcaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7050 - RNA, 4530 nt, synthetic construct
  misc_feature 1..4530: note = Cas9 variant mRNA product
  source 1..4530: mol_type = other RNA
gggagaggcgctgcctacggaggtggcagccatctccttctcggcatcaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7051 - RNA, 5313 nt, synthetic construct
  misc_feature 1..5313: note = Cas9 variant mRNA product
  source 1..5313: mol_type = other RNA
gggagaggcgctgcctacggaggtggcagccatctccttctcggcatcaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7052 - RNA, 3585 nt, synthetic construct
  misc_feature 1..3585: note = Cas9 variant mRNA product
  source 1..3585: mol_type = other RNA
gggagaggcgctgcctacggaggtggcagccatctccttctcggcatcaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7053 - RNA, 4653 nt, synthetic construct
  misc_feature 1..4653: note = Cas9 variant mRNA product
  source 1..4653: mol_type = other RNA
gggagaggcgctgcctacggaggtggcagccatctccttctcggcatcaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7054 - RNA, 3729 nt, synthetic construct
  misc_feature 1..3729: note = Cas9 variant mRNA product
  source 1..3729: mol_type = other RNA
gggagaggcgctgcctacggaggtggcagccatctccttctcggcatcaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7055 - RNA, 4590 nt, synthetic construct
  misc_feature 1..4590: note = Cas9 variant mRNA product
  source 1..4590: mol_type = other RNA
gggagaggcgctgcctacggaggtggcagccatctccttctcggcatcaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7056 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7057 - RNA, 4428 nt, synthetic construct
  misc_feature 1..4428: note = Cas9 variant mRNA product
  source 1..4428: mol_type = other RNA
gggagaggcgctgcctacggaggtggcagccatctccttctcggcatcaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7058 - RNA, 4461 nt, synthetic construct
  misc_feature 1..4461: note = Cas9 variant mRNA product
  source 1..4461: mol_type = other RNA
gggagaggcgctgcctacggaggtggcagccatctccttctcggcatcaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7059 - RNA, 3594 nt, synthetic construct
  misc_feature 1..3594: note = Cas9 variant mRNA product
  source 1..3594: mol_type = other RNA
gggagaggcgctgcctacggaggtggcagccatctccttctcggcatcaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7060 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7061 - RNA, 3678 nt, synthetic construct
  misc_feature 1..3678: note = Cas9 variant mRNA product
  source 1..3678: mol_type = other RNA
gggagaggcgctgcctacggaggtggcagccatctccttctcggcatcaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7062 - RNA, 3378 nt, synthetic construct
  misc_feature 1..3378: note = Cas9 variant mRNA product
  source 1..3378: mol_type = other RNA
gggagaggcgctgcctacggaggtggcagccatctccttctcggcatcaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7063 - RNA, 3789 nt, synthetic construct
  misc_feature 1..3789: note = Cas9 variant mRNA product
  source 1..3789: mol_type = other RNA
gggagaggcgctgcctacggaggtggcagccatctccttctcggcatcaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7064 - RNA, 4347 nt, synthetic construct
  misc_feature 1..4347: note = Cpf1 variant mRNA product
  source 1..4347: mol_type = other RNA
gggagaggcgctgcctacggaggtggcagccatctccttctcggcatcaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7065 - RNA, 4326 nt, synthetic construct
  misc_feature 1..4326: note = Cpf1 variant mRNA product
  source 1..4326: mol_type = other RNA
gggagaggcgctgcctacggaggtggcagccatctccttctcggcatcaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 7066 - RNA, 4582 nt, synthetic construct
  misc_feature 1..4582: note = Cas9 variant mRNA product
  source 1..4582: mol_type = other RNA
ggggcgctgcctacggaggtggcagccatctccttctcggcatcaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7067 - RNA, 5365 nt, synthetic construct
  misc_feature 1..5365: note = Cas9 variant mRNA product
  source 1..5365: mol_type = other RNA
ggggcgctgcctacggaggtggcagccatctccttctcggcatcaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7068 - RNA, 3637 nt, synthetic construct
  misc_feature 1..3637: note = Cas9 variant mRNA product
  source 1..3637: mol_type = other RNA
ggggcgctgcctacggaggtggcagccatctccttctcggcatcaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7069 - RNA, 4705 nt, synthetic construct
  misc_feature 1..4705: note = Cas9 variant mRNA product
  source 1..4705: mol_type = other RNA
ggggcgctgcctacggaggtggcagccatctccttctcggcatcaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7070 - RNA, 3781 nt, synthetic construct
  misc_feature 1..3781: note = Cas9 variant mRNA product
  source 1..3781: mol_type = other RNA
ggggcgctgcctacggaggtggcagccatctccttctcggcatcaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7071 - RNA, 4642 nt, synthetic construct
  misc_feature 1..4642: note = Cas9 variant mRNA product
  source 1..4642: mol_type = other RNA
ggggcgctgcctacggaggtggcagccatctccttctcggcatcaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7072 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7073 - RNA, 4480 nt, synthetic construct
  misc_feature 1..4480: note = Cas9 variant mRNA product
  source 1..4480: mol_type = other RNA
ggggcgctgcctacggaggtggcagccatctccttctcggcatcaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7074 - RNA, 4513 nt, synthetic construct
  misc_feature 1..4513: note = Cas9 variant mRNA product
  source 1..4513: mol_type = other RNA
ggggcgctgcctacggaggtggcagccatctccttctcggcatcaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7075 - RNA, 3646 nt, synthetic construct
  misc_feature 1..3646: note = Cas9 variant mRNA product
  source 1..3646: mol_type = other RNA
ggggcgctgcctacggaggtggcagccatctccttctcggcatcaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7076 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7077 - RNA, 3730 nt, synthetic construct
  misc_feature 1..3730: note = Cas9 variant mRNA product
  source 1..3730: mol_type = other RNA
ggggcgctgcctacggaggtggcagccatctccttctcggcatcaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7078 - RNA, 3430 nt, synthetic construct
  misc_feature 1..3430: note = Cas9 variant mRNA product
  source 1..3430: mol_type = other RNA
ggggcgctgcctacggaggtggcagccatctccttctcggcatcaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7079 - RNA, 3841 nt, synthetic construct
  misc_feature 1..3841: note = Cas9 variant mRNA product
  source 1..3841: mol_type = other RNA
ggggcgctgcctacggaggtggcagccatctccttctcggcatcaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7080 - RNA, 4399 nt, synthetic construct
  misc_feature 1..4399: note = Cpf1 variant mRNA product
  source 1..4399: mol_type = other RNA
ggggcgctgcctacggaggtggcagccatctccttctcggcatcaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7081 - RNA, 4378 nt, synthetic construct
  misc_feature 1..4378: note = Cpf1 variant mRNA product
  source 1..4378: mol_type = other RNA
ggggcgctgcctacggaggtggcagccatctccttctcggcatcaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 7082 - RNA, 4484 nt, synthetic construct
  misc_feature 1..4484: note = Cas9 variant mRNA product
  source 1..4484: mol_type = other RNA
gggagagtcccgcagtcggcgtccagcggctctgcttgttcgtgtgtgtgtcgttgcaggccttattcaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7083 - RNA, 5267 nt, synthetic construct
  misc_feature 1..5267: note = Cas9 variant mRNA product
  source 1..5267: mol_type = other RNA
gggagagtcccgcagtcggcgtccagcggctctgcttgttcgtgtgtgtgtcgttgcaggccttattcaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7084 - RNA, 3539 nt, synthetic construct
  misc_feature 1..3539: note = Cas9 variant mRNA product
  source 1..3539: mol_type = other RNA
gggagagtcccgcagtcggcgtccagcggctctgcttgttcgtgtgtgtgtcgttgcaggccttattcaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7085 - RNA, 4607 nt, synthetic construct
  misc_feature 1..4607: note = Cas9 variant mRNA product
  source 1..4607: mol_type = other RNA
gggagagtcccgcagtcggcgtccagcggctctgcttgttcgtgtgtgtgtcgttgcaggccttattcaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7086 - RNA, 3683 nt, synthetic construct
  misc_feature 1..3683: note = Cas9 variant mRNA product
  source 1..3683: mol_type = other RNA
gggagagtcccgcagtcggcgtccagcggctctgcttgttcgtgtgtgtgtcgttgcaggccttattcaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7087 - RNA, 4544 nt, synthetic construct
  misc_feature 1..4544: note = Cas9 variant mRNA product
  source 1..4544: mol_type = other RNA
gggagagtcccgcagtcggcgtccagcggctctgcttgttcgtgtgtgtgtcgttgcaggccttattcaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7088 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7089 - RNA, 4382 nt, synthetic construct
  misc_feature 1..4382: note = Cas9 variant mRNA product
  source 1..4382: mol_type = other RNA
gggagagtcccgcagtcggcgtccagcggctctgcttgttcgtgtgtgtgtcgttgcaggccttattcaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7090 - RNA, 4415 nt, synthetic construct
  misc_feature 1..4415: note = Cas9 variant mRNA product
  source 1..4415: mol_type = other RNA
gggagagtcccgcagtcggcgtccagcggctctgcttgttcgtgtgtgtgtcgttgcaggccttattcaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7091 - RNA, 3548 nt, synthetic construct
  misc_feature 1..3548: note = Cas9 variant mRNA product
  source 1..3548: mol_type = other RNA
gggagagtcccgcagtcggcgtccagcggctctgcttgttcgtgtgtgtgtcgttgcaggccttattcaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7092 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7093 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7094 - RNA, 3332 nt, synthetic construct
  misc_feature 1..3332: note = Cas9 variant mRNA product
  source 1..3332: mol_type = other RNA
gggagagtcccgcagtcggcgtccagcggctctgcttgttcgtgtgtgtgtcgttgcaggccttattcaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7095 - RNA, 3743 nt, synthetic construct
  misc_feature 1..3743: note = Cas9 variant mRNA product
  source 1..3743: mol_type = other RNA
gggagagtcccgcagtcggcgtccagcggctctgcttgttcgtgtgtgtgtcgttgcaggccttattcaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7096 - RNA, 4301 nt, synthetic construct
  misc_feature 1..4301: note = Cpf1 variant mRNA product
  source 1..4301: mol_type = other RNA
gggagagtcccgcagtcggcgtccagcggctctgcttgttcgtgtgtgtgtcgttgcaggccttattcaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7097 - RNA, 4280 nt, synthetic construct
  misc_feature 1..4280: note = Cpf1 variant mRNA product
  source 1..4280: mol_type = other RNA
gggagagtcccgcagtcggcgtccagcggctctgcttgttcgtgtgtgtgtcgttgcaggccttattcaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7098 - RNA, 4581 nt, synthetic construct
  misc_feature 1..4581: note = Cas9 variant mRNA product
  source 1..4581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7099 - RNA, 5364 nt, synthetic construct
  misc_feature 1..5364: note = Cas9 variant mRNA product
  source 1..5364: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7100 - RNA, 3636 nt, synthetic construct
  misc_feature 1..3636: note = Cas9 variant mRNA product
  source 1..3636: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7101 - RNA, 4704 nt, synthetic construct
  misc_feature 1..4704: note = Cas9 variant mRNA product
  source 1..4704: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7102 - RNA, 3780 nt, synthetic construct
  misc_feature 1..3780: note = Cas9 variant mRNA product
  source 1..3780: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7103 - RNA, 4641 nt, synthetic construct
  misc_feature 1..4641: note = Cas9 variant mRNA product
  source 1..4641: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7104 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7105 - RNA, 4479 nt, synthetic construct
  misc_feature 1..4479: note = Cas9 variant mRNA product
  source 1..4479: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7106 - RNA, 4512 nt, synthetic construct
  misc_feature 1..4512: note = Cas9 variant mRNA product
  source 1..4512: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7107 - RNA, 3645 nt, synthetic construct
  misc_feature 1..3645: note = Cas9 variant mRNA product
  source 1..3645: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7108 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7109 - RNA, 3729 nt, synthetic construct
  misc_feature 1..3729: note = Cas9 variant mRNA product
  source 1..3729: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7110 - RNA, 3429 nt, synthetic construct
  misc_feature 1..3429: note = Cas9 variant mRNA product
  source 1..3429: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7111 - RNA, 3840 nt, synthetic construct
  misc_feature 1..3840: note = Cas9 variant mRNA product
  source 1..3840: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7112 - RNA, 4398 nt, synthetic construct
  misc_feature 1..4398: note = Cpf1 variant mRNA product
  source 1..4398: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7113 - RNA, 4377 nt, synthetic construct
  misc_feature 1..4377: note = Cpf1 variant mRNA product
  source 1..4377: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 7114 - RNA, 4517 nt, synthetic construct
  misc_feature 1..4517: note = Cas9 variant mRNA product
  source 1..4517: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7115 - RNA, 5300 nt, synthetic construct
  misc_feature 1..5300: note = Cas9 variant mRNA product
  source 1..5300: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7116 - RNA, 3572 nt, synthetic construct
  misc_feature 1..3572: note = Cas9 variant mRNA product
  source 1..3572: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7117 - RNA, 4640 nt, synthetic construct
  misc_feature 1..4640: note = Cas9 variant mRNA product
  source 1..4640: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7118 - RNA, 3716 nt, synthetic construct
  misc_feature 1..3716: note = Cas9 variant mRNA product
  source 1..3716: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7119 - RNA, 4577 nt, synthetic construct
  misc_feature 1..4577: note = Cas9 variant mRNA product
  source 1..4577: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7120 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7121 - RNA, 4415 nt, synthetic construct
  misc_feature 1..4415: note = Cas9 variant mRNA product
  source 1..4415: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7122 - RNA, 4448 nt, synthetic construct
  misc_feature 1..4448: note = Cas9 variant mRNA product
  source 1..4448: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7123 - RNA, 3581 nt, synthetic construct
  misc_feature 1..3581: note = Cas9 variant mRNA product
  source 1..3581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7124 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7125 - RNA, 3665 nt, synthetic construct
  misc_feature 1..3665: note = Cas9 variant mRNA product
  source 1..3665: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7126 - RNA, 3365 nt, synthetic construct
  misc_feature 1..3365: note = Cas9 variant mRNA product
  source 1..3365: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7127 - RNA, 3776 nt, synthetic construct
  misc_feature 1..3776: note = Cas9 variant mRNA product
  source 1..3776: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7128 - RNA, 4334 nt, synthetic construct
  misc_feature 1..4334: note = Cpf1 variant mRNA product
  source 1..4334: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7129 - RNA, 4313 nt, synthetic construct
  misc_feature 1..4313: note = Cpf1 variant mRNA product
  source 1..4313: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7130 - RNA, 4466 nt, synthetic construct
  misc_feature 1..4466: note = Cas9 variant mRNA product
  source 1..4466: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7131 - RNA, 5249 nt, synthetic construct
  misc_feature 1..5249: note = Cas9 variant mRNA product
  source 1..5249: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7132 - RNA, 3521 nt, synthetic construct
  misc_feature 1..3521: note = Cas9 variant mRNA product
  source 1..3521: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7133 - RNA, 4589 nt, synthetic construct
  misc_feature 1..4589: note = Cas9 variant mRNA product
  source 1..4589: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7134 - RNA, 3665 nt, synthetic construct
  misc_feature 1..3665: note = Cas9 variant mRNA product
  source 1..3665: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7135 - RNA, 4526 nt, synthetic construct
  misc_feature 1..4526: note = Cas9 variant mRNA product
  source 1..4526: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7136 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7137 - RNA, 4364 nt, synthetic construct
  misc_feature 1..4364: note = Cas9 variant mRNA product
  source 1..4364: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7138 - RNA, 4397 nt, synthetic construct
  misc_feature 1..4397: note = Cas9 variant mRNA product
  source 1..4397: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7139 - RNA, 3530 nt, synthetic construct
  misc_feature 1..3530: note = Cas9 variant mRNA product
  source 1..3530: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7140 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7141 - RNA, 3614 nt, synthetic construct
  misc_feature 1..3614: note = Cas9 variant mRNA product
  source 1..3614: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7142 - RNA, 3314 nt, synthetic construct
  misc_feature 1..3314: note = Cas9 variant mRNA product
  source 1..3314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7143 - RNA, 3725 nt, synthetic construct
  misc_feature 1..3725: note = Cas9 variant mRNA product
  source 1..3725: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7144 - RNA, 4283 nt, synthetic construct
  misc_feature 1..4283: note = Cpf1 variant mRNA product
  source 1..4283: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7145 - RNA, 4262 nt, synthetic construct
  misc_feature 1..4262: note = Cpf1 variant mRNA product
  source 1..4262: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 7146 - RNA, 4452 nt, synthetic construct
  misc_feature 1..4452: note = Cas9 variant mRNA product
  source 1..4452: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7147 - RNA, 5235 nt, synthetic construct
  misc_feature 1..5235: note = Cas9 variant mRNA product
  source 1..5235: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7148 - RNA, 3507 nt, synthetic construct
  misc_feature 1..3507: note = Cas9 variant mRNA product
  source 1..3507: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7149 - RNA, 4575 nt, synthetic construct
  misc_feature 1..4575: note = Cas9 variant mRNA product
  source 1..4575: mol_type = other RNA
gggagagtccgctcagccaggttgcagaagcggcttagcgtgtgtcctaatcttctctctgcgtgtaggtaggcctgtgccgcaaacaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7150 - RNA, 3651 nt, synthetic construct
  misc_feature 1..3651: note = Cas9 variant mRNA product
  source 1..3651: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7151 - RNA, 4512 nt, synthetic construct
  misc_feature 1..4512: note = Cas9 variant mRNA product
  source 1..4512: mol_type = other RNA
gggagagtccgctcagccaggttgcagaagcggcttagcgtgtgtcctaatcttctctctgcgtgtaggtaggcctgtgccgcaaacaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7152 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7153 - RNA, 4350 nt, synthetic construct
  misc_feature 1..4350: note = Cas9 variant mRNA product
  source 1..4350: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7154 - RNA, 4383 nt, synthetic construct
  misc_feature 1..4383: note = Cas9 variant mRNA product
  source 1..4383: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7155 - RNA, 3516 nt, synthetic construct
  misc_feature 1..3516: note = Cas9 variant mRNA product
  source 1..3516: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7156 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7157 - RNA, 3600 nt, synthetic construct
  misc_feature 1..3600: note = Cas9 variant mRNA product
  source 1..3600: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7158 - RNA, 3300 nt, synthetic construct
  misc_feature 1..3300: note = Cas9 variant mRNA product
  source 1..3300: mol_type = other RNA
gggagagtccgctcagccaggttgcagaagcggcttagcgtgtgtcctaatcttctctctgcgtgtaggtaggcctgtgccgcaaacaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7159 - RNA, 3711 nt, synthetic construct
  misc_feature 1..3711: note = Cas9 variant mRNA product
  source 1..3711: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7160 - RNA, 4269 nt, synthetic construct
  misc_feature 1..4269: note = Cpf1 variant mRNA product
  source 1..4269: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7161 - RNA, 4248 nt, synthetic construct
  misc_feature 1..4248: note = Cpf1 variant mRNA product
  source 1..4248: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7162 - RNA, 4433 nt, synthetic construct
  misc_feature 1..4433: note = Cas9 variant mRNA product
  source 1..4433: mol_type = other RNA
gggagagtcccgcagtcggcgtccagcggctctgcttgttcgtgtgtgtgtcgttgcaggccttattcaagcttaccatggcccccaaaaagaagagaaaggtaggcatacacggcgtccccgccgccgacaaaaagtactcaatcggccttgacataggcactaactctgttggatgggctgtaataacggatgaatacaaagtacccagcaagaaatttaaagtactggggaacaccgaccgacactcaataaagaaaaatcttattggcgcactcctgttcgactcgggcgagaccgcggaagcgactcgcctaaaacggacggcccgccgacgctacacgagacgcaagaaccgcatatgctatctgcaagagatattctcgaacgaaatggcaaaagtcgacgacagcttcttccacaggttagaagagagcttcctcgtcgaagaagacaagaagcacgaacgtcatccaatattcggcaatatagtggacgaagtggcataccacgagaaatatccaacgatctaccatctgcggaaaaagctggtagattccaccgacaaagcagacctccgccttatctacctagcactggcccacatgatcaaattccgcgggcacttcctcatcgaaggagacctaaaccccgataactccgacgtcgacaaactattcatccaattagtccagacatacaaccaactcttcgaagaaaatcccataaatgcctccggcgtcgacgcaaaagccatcctctcggcgagactctctaagtcacgtcgcttagaaaacctcattgcacaactgcccggagaaaagaaaaacggcctctttggaaacctaatcgccctcagcctcggactcacacccaacttcaaatccaacttcgacctcgccgaagacgccaaactacaactaagcaaagatacctacgacgacgacctggacaacctgctggcacaaatcggggaccagtacgcggatctgttcttagccgccaaaaatctctccgacgcgattctgctatcggatatacttcgagtaaacaccgaaatcacgaaagcacccctctccgcctcgatgatcaaacgttacgacgaacatcaccaggacctcacactcctaaaagcactcgtgcgccagcaactgcccgagaagtacaaggaaatcttcttcgaccagtcgaaaaacggctacgccgggtacatcgacgggggcgcatcccaagaagagttctacaaatttattaaaccgatactggagaaaatggacggaactgaagaactgctcgtcaagctgaaccgtgaagaccttctccgcaaacagcgaacgttcgacaacggctcaatcccccaccaaattcacctcggagaactacatgccatcctacgacgtcaagaagacttctacccatttctcaaggacaaccgcgagaaaattgagaaaatactcacattccggatcccctattacgtcgggccactcgcccggggcaactcacgcttcgcatggatgacccggaaaagtgaagaaaccatcacaccctggaacttcgaagaagtagtagacaaaggcgcaagcgcccaatcatttatagaacgaatgacaaacttcgacaaaaacctcccaaacgaaaaagtactacccaagcactcacttctctacgaatacttcacagtctacaacgaactcactaaagtcaaatacgttacagaagggatgcggaaacccgccttcctctccggtgaacagaaaaaggccattgtggatttactcttcaagaccaaccgaaaagtcactgtcaagcagctcaaggaagattacttcaagaaaatagaatgcttcgacagcgtagaaatatcaggagtcgaagaccgcttcaacgccagcctcggaacctaccacgacctgctaaaaatcatcaaagataaagacttcctcgacaacgaagaaaatgaagacatcttggaggacatagttttaaccctaaccctgttcgaagatagggaaatgatcgaggaacgactgaaaacatacgcccacctattcgacgacaaagtaatgaaacaacttaaacgccgccgctacaccggctggggccgcctatcccgcaaactaataaacggcatacgagacaaacagagtggaaaaacaatactagacttcctaaaaagcgacggcttcgcaaaccgcaacttcatgcaactaatccatgacgacagcctaacattcaaagaagacatccagaaagcacaagtctcgggacaaggcgattccctccacgaacacatcgcgaacctcgccgggtcacccgccataaagaaaggaatcctacaaacagtcaaagtagtagacgaactcgtgaaggtcatgggacgacacaagcccgaaaacatagtaatcgaaatggcacgagagaaccagacaacacagaagggccagaaaaacagccgggagcgcatgaaacgaatcgaggaggggatcaaagaactgggatcacaaatcctcaaagaacacccagttgaaaacacccaactccaaaatgaaaaactctacctatactacctccaaaacggtcgcgacatgtacgttgaccaggaactcgacatcaaccgcctaagcgattatgacgtcgaccacatcgttccgcaatcattcctaaaggacgacagcatcgacaacaaagtactcacccgaagcgacaaaaatcgcggcaaatccgacaacgtcccctccgaagaggtcgtcaagaaaatgaaaaattactggcgacaattactcaacgcaaaactcatcactcagaggaaattcgataacctaacgaaagccgaacggggaggcctctccgaactcgacaaagcaggctttatcaagcgacagctagtcgaaacacgacaaataactaagcacgtggcccaaatactagactcccgaatgaacacaaaatacgacgaaaacgacaaactcatccgcgaagtgaaagtcatcacgctcaaatccaagctagtcagcgacttccgaaaagatttccagttctacaaggtgcgtgaaatcaataattaccaccatgcacacgacgcatatttgaacgctgtggtcgggacggccttaataaagaaataccccaaacttgaaagtgagttcgtatacggcgactacaaagtatatgacgtccgtaaaatgattgccaaaagcgaacaagaaataggaaaagcgacagcaaaatatttcttctacagcaacatcatgaactttttcaagacggaaatcacgctggcaaacggcgaaatcaggaaacggccgctcatcgaaaccaacggcgagacgggcgaaatagtatgggacaaagggcgggatttcgccacagtgagaaaagtactgtccatgccacaagtgaacatcgtcaagaagacggaagtccaaacaggcggcttctccaaagagtcaatactgcccaaacgaaattccgacaaactgatcgcgcggaagaaagactgggatccaaagaaatacggcgggttcgactcgcccaccgtggcctactcagtcctcgtagtagcgaaggtggagaagggaaaaagtaagaaactgaaaagcgtaaaagaacttctcggcatcacgatcatggagaggagctccttcgagaaaaacccaatagacttcctcgaagcgaaggggtacaaggaagtcaagaaggacctcatcattaaactgcccaaatactcgctattcgaactagaaaacggacgaaagcgcatgttagcctccgcgggcgaattacagaagggcaatgaattagcccttccaagcaagtacgtcaacttcctctatcttgcctcccattacgaaaaactaaaaggatcgccagaagacaacgagcaaaaacagttattcgtcgaacagcacaaacactatctcgacgagatcatcgaacaaatctcggagttcagtaaaagagtaatccttgcagacgcaaacctagacaaggtactgtcagcgtacaataaacaccgggacaagcccatccgcgaacaggctgaaaacataatccatctctttacactcaccaacctcggcgccccagcagcctttaagtacttcgacacaactatagaccgtaaacgttatacaagtaccaaagaagtcctggacgctaccctcatccaccaatcgataacgggcctctatgaaacacgcattgacttgtctcaactcggcggagacaagcgccccgccgcgacaaagaaagcaggacaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7163 - RNA, 5216 nt, synthetic construct
  misc_feature 1..5216: note = Cas9 variant mRNA product
  source 1..5216: mol_type = other RNA
gggagagtcccgcagtcggcgtccagcggctctgcttgttcgtgtgtgtgtcgttgcaggccttattcaagcttaccatggcgccgaaaaagaaacgaaaagtaggtatccacggagtcccagccgcaaacttcaaaatcctgcccatagccatagacctgggagtcaaaaatactggcgtcttctccgcattctaccaaaaaggaacgtcgctcgaaaggctagataacaaaaacggcaaagtatacgaactctccaaggactcctatacacttctcatgaacaaccgcacggcacgtcggcaccagcgccgaggtatagaccgcaaacaactggttaagcgcttgttcaaactcatctggacagaacaactcaacctagagtgggacaaagacacccaacaggccatctccttcctattcaaccgtcgaggattctccttcatcaccgacgggtactcgccggaatacctcaacatcgtcccagaacaagtcaaagcaatcctcatggatatcttcgacgactacaacggtgaggatgacctggatagctacctcaagctggcaaccgagcaagaatcgaaaataagcgagatatacaataaactgatgcagaagatcctagagttcaaactcatgaagctatgcacagacatcaaagatgacaaggtatcgacgaagaccttaaaagaaatcacgagctacgagttcgaactactcgccgactacctcgccaattacagcgaatcattgaaaacccagaaattctcctacaccgacaaacagggcaacctcaaagaactatcgtactaccatcatgacaagtacaacatacaagagttcctgaaaagacatgccaccatcaacgaccgtatcctcgacactttattgaccgacgacctcgacatctggaatttcaatttcgagaaatttgacttcgacaaaaatgaagaaaagctgcagaatcaggaagacaaagaccacatacaagctcatctgcaccacttcgtcttcgcagtcaataagatcaagtccgagatggcatcaggcggccgacaccgcagccaatatttccaagagatcaccaacgtcctagatgaaaacaaccaccaagagggatacctcaaaaacttctgcgaaaatctacacaacaaaaagtactccaatctgagcgtcaaaaacctcgtcaacctcataggcaacctctcgaacctagagctcaaacccctccgcaagtatttcaacgacaagattcacgccaaggcagaccactgggacgagcaaaagttcacagaaacctactgtcattggatcttaggagagtggagagtcggcgtgaaggatcaagacaaaaaggacggtgccaaatactcctacaaggacctctgtaacgagctgaaacaaaaggtaaccaaggccggcctggtagactttctactcgaacttgacccatgtcgcacgatacccccatatctcgacaacaacaaccgcaagccgcccaaatgccaatcgttaatcctcaaccccaagtttctagacaatcaataccccaactggcagcagtacctacaggaacttaagaaactccaatccatacaaaactacctcgactcctttgaaaccgacctgaaagtcctaaaaagcagtaaggatcaaccctacttcgtcgaatataaatccagcaaccaacaaatcgcatccggacaacgagactataaggacctagacgcacgtatcctccaattcattttcgatagggtaaaggcttccgacgaactactactaaacgagatctatttccaagcaaagaaactgaaacagaaggcctcgagcgagctagaaaaactggaatccagcaagaagctggacgaagtgatcgcaaactcccagctctcgcaaatattaaagtcccaacacaccaacggaatcttcgaacaaggtactttccttcacctagtatgcaagtattacaagcaacgacaacgcgcaagggattcacgcctctacatcatgcccgagtaccgctacgataaaaagctgcacaagtataacaacaccggccgcttcgacgacgacaaccagctactcacttactgcaaccacaaaccgagacagaaacgctaccaacttctcaacgacctcgccggggttttgcaggtatccccaaacttcctaaaagacaagatcgggtccgacgacgaccttttcatctcaaagtggctcgtagagcacatccgaggtttcaaaaaggcgtgcgaggactcgctaaaaatacaaaaggacaaccgcggcctactcaatcataaaataaatatcgcccgtaatacgaagggcaaatgcgaaaaggaaatcttcaacctgatctgcaaaatagagggctccgaagataagaaaggcaactacaaacacggactcgcctacgagttgggcgtcctactattcggcgagcccaacgaagcatcaaagccagagttcgaccgcaagatcaaaaagttcaattcaatatactcctttgcacaaatacaacagatcgccttcgccgaacgtaagggaaacgcgaatacttgcgccgtgtgctcagcagataacgcccatcgcatgcagcagataaaaatcaccgagcctgttgaggacaacaaagacaagataatactaagcgcgaaagcccagcgccttcccgccataccaacccgcatagtcgacggggccgtcaagaaaatggcaacgatcctcgctaaaaacatcgtagacgacaactggcagaacataaaacaagttctaagcgcaaaacaccaacttcacattcccatcataaccgaatcgaacgcgttcgagttcgagccagcactggcagacgttaaaggaaagagccttaaggatcgaagaaagaaagccctcgaacgaataagtcccgagaacatcttcaaggacaaaaataatcgtataaaagaatttgcgaaaggcatatcagcctacagcggcgccaacctaaccgacggcgactttgacggcgccaaagaggaactcgaccacataatacccagaagccacaagaaatatggcacgctgaatgacgaggcgaacctaatctgcgtaaccagaggcgataataaaaacaagggaaaccgaatcttctgtctgcgagatctcgccgataactacaaactcaagcaatttgaaaccacggacgacttagagatcgaaaagaaaatagcagacactatctgggacgccaacaagaaagacttcaaattcggaaactatcgcagcttcatcaatctaacgccgcaagaacaaaaagcattccgacacgccctcttcctcgccgatgaaaatccaatcaaacaagccgtaatacgcgctatcaacaaccgaaaccgaaccttcgtcaacggcacccaacgctactttgccgaagtactcgcaaacaacatctacctgcgagccaaaaaggagaacctaaacacagataagatctcctttgactacttcggcatacccacaatcggaaacggacgaggcatcgctgagatccgccaactatacgagaaagtcgacagcgacatccaagcatacgccaaaggtgacaaacctcaggccagctactctcacctcatcgacgccatgcttgcgttctgcatcgcggcggacgagcaccgaaacgatggttccatcggcctagaaatcgacaaaaactacagcctgtacccactagacaaaaacaccggagaagtttttaccaaagacatatttagccaaatcaagattaccgataacgagttcagtgacaagaagctagttcggaaaaaggctatcgaaggctttaacacgcacagacaaatgacccgcgacggcatctacgccgaaaactacctccccatccttatccacaaggaactcaacgaggtacggaaaggctatacgtggaaaaactcggaggaaatcaagatcttcaaaggcaagaaatacgacattcaacaactcaacaatctcgtctattgcctcaaattcgtcgataaaccgattagcatagacatccaaatctcaaccctggaggaactccgcaacatcttaacaacgaacaacattgcggcgaccgccgagtattactacatcaacctcaagacacagaaacttcacgagtactacatcgaaaactacaacaccgcactaggctataaaaagtactccaaggaaatggaatttctaagatccctcgcctaccgatcagaaagagtcaaaatcaaatcaattgacgacgtcaagcaagttctagacaaagacagcaacttcatcatcgggaagatcacgcttcccttcaagaaagaatggcagcgcctctacagagaatggcaaaacaccacaatcaaagatgactacgagttccttaaatcattcttcaacgtaaaaagcataacaaaacttcataaaaaggtaaggaaggatttctcactccccatctccacaaacgaaggcaagttccttgtcaaacgcaagacatgggacaacaacttcatataccaaatcctaaacgatagcgactccagagctgacggcacaaagccattcataccggcatttgacatctcaaagaacgaaatagtcgaagcaatcattgacagcttcacaagtaaaaacatcttttggcttccaaagaacatagagctgcaaaaagtagacaacaaaaacatcttcgccattgacacgagcaaatggttcgaagtggaaacgccctctgacctaagagatatagggatcgcaacaatccaatacaagatagataacaacagccgaccaaaagtaagagtaaaactcgactacgtcatcgacgacgatagtaaaataaactactttatgaaccattccctgctaaaatcccgatacccggacaaagtcctggaaatcttgaaacagtccactatcatcgagttcgaaagttccggattcaacaagaccataaaggaaatgctgggcatgaaactcgccggtatttacaacgaaaccagcaacaataagaggccagccgccaccaagaaggccggccaggcgaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7164 - RNA, 3488 nt, synthetic construct
  misc_feature 1..3488: note = Cas9 variant mRNA product
  source 1..3488: mol_type = other RNA
gggagagtcccgcagtcggcgtccagcggctctgcttgttcgtgtgtgtgtcgttgcaggccttattcaagcttaccatggcccccaaaaagaaacggaaggtgggcatacacggcgtccccgcagcaaaaagaaactacatcctagggctagatataggcatcacctccgtcggctacggcataatagactacgaaacaagggatgtcatcgacgcgggggtacgcctattcaaagaagcaaacgtcgagaacaacgaaggacgcaggtcaaaacgaggagcacggcgactgaagcgacgcagacgacaccgcatccaacgggtcaagaagctcttattcgactacaacctgctaacggaccactcggaactgtctggcatcaacccctacgaggcccgagtcaaaggactcagccaaaaactatccgaagaagagttctccgcagccttactgcacctggcaaagagacgcggtgtacacaacgtaaacgaggtcgaggaagataccgggaacgagctatccacaaaggaacagatcagcaggaacagcaaagcactcgaggagaaatacgtagcggaactccagctcgaacgactcaaaaaggacggcgaagtccgtggctccataaaccgattcaagacatcggactacgttaaggaggccaagcaactcctaaaagtccaaaaagcctaccaccaactagaccagagctttatcgacacgtacattgatctactcgagacgcgaaggacctactacgaaggcccgggagaaggcagtccattcgggtggaaagacatcaaagagtggtacgaaatgctcatggggcactgcacctacttcccagaagaactgcgctcagtcaagtacgcttacaacgccgacctctacaacgccttgaacgatctaaacaacctcgttataacccgagacgagaacgagaaattggaatactacgagaagttccaaataatagaaaacgtattcaaacagaaaaagaaaccgaccctaaaacaaatcgccaaagagatcctggtcaatgaggaagacataaaagggtaccgcgtaacctccacgggcaagccagagttcacgaacctcaaagtctaccacgatatcaaggacatcaccgcacggaaggaaatcatagaaaacgccgaactactcgatcaaatcgccaaaatactcaccatctaccaaagctcggaggacatacaagaagaacttaccaacctaaactctgaattaacgcaagaggagatcgagcaaatatcaaacctcaaaggctacaccggcacacacaatctctcgctcaaggcaataaacctcatcctggatgaactatggcacacgaacgataaccaaatagccatcttcaaccgcctcaagctggtcccgaagaaagtcgacctatcgcaacaaaaagagatcccaaccacactcgtagacgacttcatactctcgccagtggttaaacgctcgttcatccaatccatcaaagtcatcaacgccatcatcaaaaagtacggcctaccaaacgacatcatcattgagctagcccgcgagaaaaactccaaagatgcgcagaaaatgatcaacgaaatgcagaaacggaacagacaaacgaacgaaagaatcgaagagataatacgcaccaccggcaaagaaaacgcaaaatacctcatagagaaaatcaagctccatgacatgcaagaaggaaagtgcctatactcgttggaagccatccccctggaagatctacttaacaaccccttcaactacgaagtcgaccacatcatcccgcgatcagtctcattcgacaacagcttcaacaacaaggtcctagtaaaacaagaagaaaactccaagaaaggcaaccgcacccccttccaatacctaagtagctcagactcaaaaatcagctacgaaacgttcaagaaacacatactcaaccttgcgaaaggcaaaggacgtataagcaaaactaaaaaggaatacctactagaggaaagagacatcaaccgattcagcgtacagaaagacttcataaatcggaacctcgtcgacacccgatacgcaacccgcggcctcatgaacctgctgcgatcatatttcagggtcaataacctcgacgtaaaggtcaagtccatcaacggtgggttcacttcattccttcgcagaaaatggaaattcaaaaaggaacgcaacaaaggctacaaacaccacgccgaagacgccctgataattgcaaacgcagacttcatctttaaagaatggaaaaagctagacaaggcaaagaaagtcatggaaaaccaaatgttcgaagaaaaacaagcagagtccatgcccgaaatagagacggagcaagaatacaaagaaatcttcatcacaccccaccaaataaaacatataaaagactttaaagactacaagtattcgcatagagtagataagaaacccaaccgagagctcatcaacgacaccctctactcgacccgcaaagacgacaagggcaacacgctcatagtcaacaacctaaacgggctctatgacaaggacaacgacaaactcaagaaactcatcaacaagtccccagagaaactcctcatgtaccaccacgacccgcagacctaccaaaaactcaaactcatcatggaacaatatggggacgagaagaaccccctctacaaatactatgaggaaaccggcaattacctcacgaaatactcaaagaaagacaacggacccgtcataaagaaaatcaaatattacggaaataaactcaacgcacacctcgatataaccgacgactaccctaactcacgcaacaaagtcgtaaaattatcactcaaaccgtaccgctttgacgtatacctggacaacggagtctacaaattcgtaaccgtaaagaacctcgacgtaataaagaaggagaactactacgaagtcaactccaaatgctacgaggaggcaaagaaactcaaaaagatatcaaaccaggccgagtttatagcttccttctacaacaacgatctgataaagatcaacggagaactctaccgcgtaatcggcgtaaacaacgacctgcttaatagaattgaggtgaacatgatagacatcacataccgcgaatacctggaaaacatgaacgacaaacgcccgccccgcataatcaaaaccatagccagcaaaacccaatccattaagaagtacagtacggacatactcggcaatctctacgaagtaaaaagcaagaaacacccccaaatcatcaagaaaggcaaacgacccgccgcaactaagaaagcaggccaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7165 - RNA, 4556 nt, synthetic construct
  misc_feature 1..4556: note = Cas9 variant mRNA product
  source 1..4556: mol_type = other RNA
gggagagtcccgcagtcggcgtccagcggctctgcttgttcgtgtgtgtgtcgttgcaggccttattcaagcttaccatggcccctaaaaagaaaagaaaagtcggcatacatggagtgccagcggccctattcaacaaatgtataatcatttccataaacctggatttctccaacaaagaaaaatgcatgacaaaaccttactccatcggactggacatcgggacaaactcggtagggtgggctgtaatcaccgacaactacaaagtaccaagcaagaaaatgaaagtcctagggaataccagcaagaaatatatcaagaaaaaccttctgggcgtcctcctgttcgactccggtattaccgccgaagggcgaaggcttaaacgcactgcgcgccgccgctacacgcgcagacgaaatcgaatactctacctccaggaaatcttctccacagaaatggcaacactcgacgacgcatttttccaacgcctcgatgacagttttctagtgccggacgacaaacgtgacagcaaatacccaatcttcggcaacttggtggaagaaaaagtctaccacgacgagttccctacgatatatcacctcagaaaatacctcgccgactccactaagaaagccgacttaagactcgtctacttggcactagcccacatgattaaatacagagggcacttcctcatcgaaggagagttcaattccaaaaacaacgacatacagaaaaacttccaggacttcctggacacctacaacgccatcttcgaatctgatctctcactggaaaactcaaaacaactcgaagaaatcgtcaaggacaaaataagcaaactagaaaagaaagaccggatcctcaaacttttccctggtgagaaaaacagcgggatattctccgagttcctcaaacttatagttggtaaccaggccgacttcagaaaatgcttcaacctagacgaaaaagcgtccttacacttctcgaaagaatcctacgacgaagacctggaaaccctgctcggatacatcggagacgactactccgatgtcttcctgaaagccaagaaattatatgatgcaatcctgctctccggcttcctaaccgtaaccgacaacgaaactgaagcgcctctttcttccgccatgataaagcgctacaacgaacataaagaagacctcgcgctcctgaaggaatacatcagaaacataagtctgaaaacttacaacgaagtcttcaaagacgacactaaaaacgggtacgcaggatatatcgacggaaaaactaaccaagaagacttctacgtctatctcaaaaacctcctagcagagttcgaaggagccgattactttctcgaaaagattgaccgagaagattttctacgcaaacaacgtacattcgataatggatcaatcccgtatcaaatacacctacaagaaatgcgcgccatcttagacaaacaggccaagttctacccgttcctggctaaaaacaaagaacgaatagagaaaatcctgacctttcggattccctactatgtcggccccctagcgcggggaaattctgactttgcctggtccatacgcaaacgcaacgagaaaatcaccccctggaacttcgaagacgtcatcgacaaagagtccagcgccgaggcattcataaataggatgacatccttcgacctatacctcccagaggagaaagtcctcccaaaacactccctcctatacgaaacattcaacgtctacaacgaactcacaaaagttcgtttcatcgccgagtcgatgagagactaccaattcctagactcaaaacaaaagaaagacatagtcaggctttacttcaaagacaagcggaaagtcaccgataaagacatcatcgagtacctccacgcgatctatggctacgacggcatcgagctaaagggaatcgaaaagcagttcaacagctcgctatcgacctaccacgacctattgaacataataaacgacaaagagttcctagatgattccagcaacgaggcgataatcgaagaaatcatccacaccctgaccatttttgaggaccgcgaaatgataaagcagcgcctctccaagttcgagaacatcttcgataagtcggtccttaagaaactttcccgccgccactataccggctggggtaaactatccgccaaactaatcaacggcataagagatgaaaaatccggcaatacaatactcgattacctcatcgacgacggtatatcaaaccgaaacttcatgcagctcatacacgacgacgccctttccttcaagaagaaaattcagaaagcccagatcattggggacgaagacaaagggaacataaaagaggtcgtaaagtcactgccaggatcccccgctatcaagaaggggatattacaatccatcaagatcgtcgacgagctagtgaaggttatgggcggacgcaaacccgaatcaatcgttgtcgaaatggcccgtgaaaaccaatacacgaaccaagggaaatcgaactcacagcagcggctaaaaaggctggagaaatcccttaaggagctaggctccaaaatcctgaaagagaacatccccgcaaagctatccaaaatagacaacaacgcgctccaaaacgaccgcctatacctctactacctacaaaacggtaaagacatgtacacaggggacgacctggacatagatcgactctcaaactacgacatcgaccatatcatcccccaagcattcctaaaggacaattcgatagacaacaaagtgctcgtctcttcggcctccaatcgagggaaaagcgacgacttcccctccctagaagtcgtcaagaagcggaaaacgttctggtaccagctccttaagtcaaaactcataagccaacgcaagtttgacaacctcacgaaagcagaacgtggaggtctcctaccagaagacaaagccggctttatccagagacaactcgttgaaaccagacaaatcaccaagcacgtcgcgcggcttctagacgaaaaattcaacaacaagaaagacgaaaacaaccgagctgtgcgcacagtcaaaatcatcaccctaaagtccacgctcgttagccaattccgcaaggacttcgagctgtataaggtccgcgaaataaacgacttccaccacgcgcatgacgcatacctaaatgctgttatagcgtccgcacttctaaagaaatatcccaaactcgagcccgagttcgtctacggagactacccgaaatacaactccttccgcgaacgcaaaagcgcaaccgaaaaggtatacttctactccaatataatgaacatctttaaaaagtccatctctctagccgacggacgtgtgatcgaacggcccctcatcgaagtcaacgaggaaacgggcgaatcggtctggaataaggagagcgacctagcgacggtccgacgcgtcctcagctacccccaagtcaacgtggtcaagaaagtcgaggaacaaaaccatgggctcgatcgcggcaaacctaaaggactgttcaacgccaacctctcgagcaagccgaaacctaactccaacgagaacctggtcggtgcgaaagagtacctggatcccaagaaatacggtgggtacgcgggaatcagtaattcctttgctgtcctagtaaaaggcaccatagaaaaaggggccaaaaagaaaatcaccaacgtgcttgagttccaggggatcagtatcctagacagaatcaactaccgcaaagacaagctcaacttccttctcgaaaaaggctacaaggacatagaactaatcatagaactaccaaaatatagtctatttgaactaagcgacggcagccgacggatgttagcatcgatcctcagcactaacaacaaaagaggggaaatccacaaaggcaaccagatctttctatcacaaaagttcgtgaaattactataccacgccaaaagaatatcgaatacgatcaatgaaaaccaccgaaaatacgtcgagaaccataagaaggagttcgaggagctcttttactacatcctagagttcaacgaaaactacgtcggcgccaagaaaaacggaaaactcctaaactcggcattccaaagttggcagaaccattcgatagacgaactttgcagcagcttcatcggcccaaccgggagcgaacgcaagggcctattcgagctaacatcacgcgggtccgccgcggacttcgagttcttgggtgtcaaaataccaagataccgagactacacccccagctctcttctcaaagacgccaccctcatccaccaatcggtgaccgggctctacgaaacccgcatagacctggcaaagctaggcgaagggaaacgccccgcggccactaagaaagccggacaggcaaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7166 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcacccaaaaagaaaagaaaagttggaatccacggagtacccgcggcatggtacgcaagcctcatgtctgcccaccacctaagagtaggtatagacgttggcacccactctgtcggactagccaccctacgagtcgatgaccacggaaccccaatagaactgctaagcgcactttcgcatatccacgactcaggagtgggcaaagaaggcaagaaagaccacgacaccagaaagaaattaagcggaattgcccggcgggcacgccggctactacaccaccgaagaacacagctccagcagctcgacgaggtcctgcgagacctaggattcccaatacccacaccaggggagttcctagacttaaacgaacaaaccgacccataccgagtatggagggtaagagcacgcctagtagaagagaaactacccgaagaactgcgtggacctgcaatctcaatggcggttaggcatatagcccgacacagaggatggaggaacccctactccaaagtagaatcactcctaagcccagccgaagagagcccctttatgaaagccctaagagaacgcatcctggcaactaccggcgaagtactcgacgatggcatcacacccggccaagcaatggcccaagtagccctcactcacaacatatcgatgcgcggaccagaaggcatattaggcaaactacaccagagcgataacgcaaacgaaatacgaaaaatatgcgcccgccaaggcgtatcccccgatgtatgtaaacaacttctccgggcggtatttaaagccgacagcccaagaggatcagcagtctcaagggtcgcgcccgatcccctcccaggccaagggagtttccgccgagcaccaaaatgcgacccagagttccaacgctttagaataatatcaatagtcgcaaacctcaggatatcggaaaccaaaggcgaaaacaggccgttgacagcagacgaacggaggcacgtcgtgacattcctaacagaggactcccaggcagaccttacctgggtagacgtcgctgaaaaactaggggtacatcgtcgtgacctcagagggacagcggttcataccgacgacggagagaggtcagccgcccgacccccgatcgacgccaccgacagaatcatgagacaaactaaaatatccagcctaaaaacctggtgggaagaagccgactcggaacaacgaggcgccatgatacggtacctatacgaagacccaaccgactccgaatgtgccgaaatcattgcagaactaccggaggaagaccaagccaaactagacagcctccaccttccagccgggcgcgcggcatactcacgtgagagcctaaccgccctctcagatcacatgcttgcaaccaccgacgaccttcatgaagcgaggaaaagactattcggagtggatgacagctgggccccaccggccgaagccatcaacgcaccagtcggtaacccctcagtagaccggacactcaaaatagtaggaagatacctctccgcagtagaaagcatgtggggaacacccgaggtaatccacgtagaacacgtaagagacggcttcacaagcgagcgcatggccgacgaaagagacaaggcaaaccgcaggagatataacgacaaccaagaggccatgaagaaaatccaacgggactatggaaaagaaggatacatcagcagaggcgacatagtgcgactcgacgcactagaactccaaggatgcgcatgcctttattgcggaactacaatcggatatcacacatgccaacttgaccacatagtaccacaagccggcccggggtctaataaccgaagaggaaacctagtggcggtatgtgaaagatgtaaccgatccaaatccaacacacccttcgccgtctgggcacagaaatgcggaatcccacacgtaggagtcaaagaggcgataggacgagtgagaggctggcgaaaacaaacgcccaacacctcgagcgaagacctaacaaggttaaagaaagaagttatcgccaggctaaggagaacccaagaagacccggagatagacgaacgatctatggagagcgtagcatggatggcaaatgagcttcaccatcggattgctgctgcgtacccagaaacaaccgtgatggtatacagaggatcgatcacagccgcagcacggaaagccgccgggatagattccagaattaacctaattggcgagaaaggcaggaaagacaggatagacaggcgccaccacgccgtagacgccagcgtcgtcgccctcatggaagccagcgtcgcaaaaaccctagcagaaaggtcatccctccgcggcgaacagcgcctgaccggcaaagaacagacgtggaaacagtatacaggatcgacagtgggggcacgagaacacttcgaaatgtggcgcgggcacatgctacaccttacggaactgttcaacgagcgactcgcagaagacaaagtatacgttacccagaacatacgactacgattgtcagacggaaacgcccacacggtaaacccatcaaaactggtgtctcaccgtcttggcgacggactcaccgtacagcaaatcgacagagcctgcacgcccgccctatggtgcgccctaaccagagagaaagactttgatgagaaaaacggactaccggcacgagaagacagggccataagagtacacggccacgaaatcaaaagtagcgactacatacaggtattcagtaaacggaaaaagaccgactcggaccgagacgagacgcccttcggcgccatcgcagttagaggcggattcgtcgaaatcggcccatccatccatcacgcacgaatatacagggtagaaggaaagaaacccgtctacgcaatgcttagagtattcacccacgacctactaagccaacgacacggagatctcttcagcgcagtaataccaccacaatccataagcatgcgatgtgcggaaccaaagctgagaaaagccataaccacaggcaatgccacatacctcggatgggtagttgtaggcgacgaactggaaatcaatgtcgacagtttcacgaaatacgccatcgggcgattcctagaggacttcccaaacactactaggtggcgaatatgcgggtacgacacaaactcgaaactcacccttaaaccaattgtactcgccgccgaagggctcgaaaacccgtcttccgcggtcaacgaaattgtagaactaaaaggatggcgagtggccataaacgtgctaaccaaagtacacccaacggtggtacgccgagacgcactaggaaggccacgatacagctctcgctctaacctccccacgtcatggaccatagaaaaacgccccgccgctaccaaaaaggccggacaggcgaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7167 - RNA, 4493 nt, synthetic construct
  misc_feature 1..4493: note = Cas9 variant mRNA product
  source 1..4493: mol_type = other RNA
gggagagtcccgcagtcggcgtccagcggctctgcttgttcgtgtgtgtgtcgttgcaggccttattcaagcttaccatggcccccaaaaaaaaacgaaaagtaggcatccacggcgtcccggcagctacaaaaccctactccattggcctggacataggaacaaactccgtcggctgggcagtaaccacggataattacaaagtcccatcgaaaaagatgaaagtactgggtaacaccagcaagaagtatatcaaaaaaaacctgctgggggtactgctcttcgactcgggcataaccgctgaggggcgaagactcaaacgcacggcccggcgccgatatacgcgacgacgcaaccgcatactctacctgcaagagatcttctccacagaaatggcaacgctggacgacgcgttcttccaacgactagatgacagcttcctcgtgcccgacgacaagcgcgactcaaagtatcccatattcggcaacctcgtcgaagaaaaggcatatcacgacgaattccccacaatatatcatctgcgaaaatacctcgccgattctacaaagaaagcggacttacgactcgtgtatctggcgctggcccacatgatcaaatacaggggacacttcctgatagaaggcgagttcaacagcaagaacaacgacatacaaaaaaatttccaagacttcctcgacacatacaatgcaattttcgaaagcgacctcagcctcgagaacagcaaacagctggaggagatcgtaaaggacaagatttccaaactagagaaaaaagacagaatccttaaactattccccggagaaaagaacagcgggatcttcagcgaattcctcaaactgattgttggcaaccaagcggacttccgcaaatgcttcaacctggacgaaaaagctagcctccacttctccaaagaatcctatgacgaagacctggaaacactactcggttacataggagacgactactccgacgtattcttaaaggccaaaaaactctacgacgcaatactgctgtccggcttcctaaccgtcaccgacaacgaaaccgaagcaccactgagctctgcaatgatcaaacgatacaacgagcacaaggaggacctagcactactcaaggaatatatccgtaacataagccttaaaacatacaacgaggtcttcaaggacgacaccaaaaacggctacgcggggtacatcgacggaaagaccaaccaggaagacttctacgtatacctaaaaaagctcctcgcggaatttgaaggggcagactacttcttagaaaaaatagacagagaggacttcctccgtaaacaacgaacattcgacaatggctccataccctaccaaattcatctacaagaaatgcgcgccatccttgacaagcaagcgaagttctaccccttccttgcaaaaaacaaagaacgcatcgaaaagatcctaacattccgaattccatactacgtagggcccctagctcgggggaactccgacttcgcatggtccatcagaaagcgcaacgaaaaaataactccttggaatttcgaggacgtcattgacaaggagtcttccgccgaagccttcataaaccgcatgacatcctttgacctctacctaccagaggagaaagtgctaccgaagcatagcctcctatacgaaacattcaacgtatataacgaactaaccaaggtccgattcatagcagagtcaatgcgagactaccaattccttgatagtaaacaaaaaaaagacatcgttcgcctatacttcaaggacaagcgtaaggtaaccgacaaagacatcatagaatatctccacgcgatctacggttacgacggcatagaacttaagggtatagagaagcagttcaacagttcactctccacttaccacgacctcctgaacatcatcaatgacaaagagttcctagacgacagctccaacgaggccattatagaagaaatcatacacaccctaactatctttgaagacagggaaatgatcaaacaacgccttagcaagttcgaaaatatcttcgacaaatccgtcctgaaaaagctatctcggagacactacaccggctggggcaaactctccgcaaagctgatcaacgggatccgcgacgagaagtccggcaacacaatcctcgattatctaatcgatgatgggatcagcaatagaaacttcatgcaactgattcatgacgatgcactcagcttcaaaaaaaaaatacaaaaagcacaaattatcggagacgaggacaaagggaacatcaaggaagtagtaaagtcactcccaggatcaccagcgatcaaaaaagggatcttacaatccatcaaaatagtcgacgaacttgtcaaagtcatggggggccgcaagccagaatcgatagtagtcgaaatggcccgtgaaaatcaatacaccaaccaaggcaagagcaatagccaacagagactcaaacgcctagaaaagagcctcaaagaactcggtagtaagatcctgaaggaaaacatacccgccaagctaagtaaaatagacaacaacgcactccaaaacgacagactgtacctatactacctgcagaacggtaaagacatgtacacgggagacgacctggacatcgacaggctcagcaactatgacatcgaccacataattccgcaagcatttctaaaagacaatagcatagacaacaaagtcttagtatcatcagcgagcaacagaggaaagagtgacgatgtcccatccctagaggtggtgaaaaagcgaaaaaccttctggtaccaactactcaagtccaagcttatctcacagcggaagttcgacaacctcactaaggccgaaagagggggtctatcccccgaggacaaagccgggtttatacaacgccagctcgtagaaaccagacaaatcacgaaacacgtagcgcgtctcctcgacgaaaaatttaacaacaaaaaggacgaaaacaacagggcagtaagaaccgtgaaaatcatcaccctgaagtccaccctggtctcccagttccgcaaggatttcgagctttataaagtaagagaaataaacgacttccaccatgcacacgatgcctacttaaacgccgtcgtcgcctccgcactgctaaaaaagtacccgaagctggaacccgagttcgtctacggtgattatcctaaatacaattccttccgtgaaaggaagtccgcaacggaaaaagtctacttctattccaacataatgaacatattcaaaaaatccatttcactcgcggacggacgagttatagaacgaccactcatcgaagtcaacgaagaaaccggtgagagcgtatggaacaaagaatccgacctcgccaccgtacgacgggtactctcgtatcctcaagtaaacgtcgttaaaaaggtcgaagagcaaaaccacggtctcgaccgcggcaaacctaaagggctttttaacgccaacctctcgtccaagcctaaacccaactctaacgaaaacctcgtcggcgcaaaagaatatctcgaccccaagaaatacggcggatacgctgggatatcaaactccttcacagtactggttaagggcactatcgaaaaaggagccaaaaaaaaaataacgaacgtcctcgaattccagggaatttccatactcgaccggatcaactaccggaaagacaagctgaacttcctcttagaaaaggggtacaaggacatcgaacttataatcgagctgccgaagtactccctcttcgaactgagtgacggcagccgccgcatgcttgccagtatcctatccaccaacaacaagcgcggcgaaattcataaaggcaaccaaatattcctcagccaaaagttcgtcaagctattgtatcacgccaaacgtatctctaacaccatcaacgaaaaccaccgaaagtacgtagaaaaccacaaaaaagaattcgaagaactattttactacattctcgaattcaacgaaaactacgtaggcgcgaaaaagaacggcaagctacttaactccgcctttcaatcctggcagaaccacagcatagacgaactgtgcagcagcttcatcggccccaccggctccgaacgaaaggggctctttgaactaacaagcagaggatcagccgccgacttcgaattcctcggggtaaaaataccgcgctaccgagattacaccccaagctcattgctaaaagacgccactctgatacaccaaagtgtaacagggctatacgaaacgagaatcgacctagcaaaactcggcgagggcaaacgacccgcagccaccaaaaaagctggccaagctaaaaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7168 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcaccgaaaaagaaacgaaaagtcggcatccacggagtaccagccgccgccgccttcaaacccaactcaatcaactacatcctaggcctggacataggcatcgccagcgtcggatgggccatggtcgagatcgacgaggaggagaaccccatccgcctaatcgacctgggagtccgggtattcgaaagagcagaagtccccaaaaccggcgactcactagcgatggccagaaggctagcccgcagcgtaagacggctaacaaggcgcagggcccaccggctactccgcacacggcgactactcaaacgagagggcgtcctccaagcagccaacttcgacgaaaacggcctcatcaaatccctccctaacactccctggcaactccgggcagcagctctcgaccgcaaactcacaccactagaatggagtgcagttctcctccaccttatcaaacaccgcggttacctctcccaacggaaaaacgaaggcgaaacagcagacaaagaactaggcgctctcctgaaaggggtggccgggaatgcgcacgccctccaaaccggcgactttcggacacccgcagagctcgcactaaacaaattcgaaaaagaatcaggccatataagaaaccaaagatccgactactcacacacatttagccgcaaagacctccaagccgagctgattctactcttcgaaaaacaaaaagagtttggaaacccccacgtatccgggggcctaaaagaaggaatcgaaaccctcctcatgacccaaaggcccgctctgtcgggggacgccgtacaaaagatgcttggccattgcacgttcgaaccagctgaaccaaaggcggctaaaaacacatacacggccgaaagatttatatggctaacaaagctaaacaacctccgcatactagaacaaggcagcgaaagaccacttacagatacagaaagagctaccctcatggacgaaccatacagaaagtccaagctgacctatgcccaggcgcgaaaactgctcggactcgaagacacagcatttttcaagggcctacgctacggcaaggacaatgccgaagccagtaccctcatggaaatgaaagcctaccacgcaatctcccgcgcactcgaaaaggaaggactgaaagacaagaaatcacccctcaacctatcacccgaactccaggacgagatcggaaccgcattctcactgttcaaaacagatgaggacatcaccggccgactgaaagaccgaatccaaccggagatactcgaagccctcttaaaacacatctcgttcgacaaatttgtacagatctccctcaaagcacttcggaggatagtgccccttatggagcaagggaagcgctacgacgaggcatgcgcggaaatctacggggatcactacgggaagaaaaacacagaagagaaaatctacctcccaccaataccggccgacgaaatccgaaaccccgtcgtcctcagagcgctatcacaagcccgaaaagtcatcaacggggtagtccgtagatacggctcaccggcccgcatacacatcgaaacagcccgcgaagttggtaaatccttcaaagaccggaaagagattgaaaaacgacaagaagaaaaccgcaaagaccgcgaaaaagcggccgcgaaattccgtgagtacttcccaaacttcgtaggagaacccaaatccaaagacatcctaaaactccgcctgtacgaacaacaacacggaaaatgcctgtactccggaaaagaaataaacttgggacgactcaacgaaaaaggctacgtcgaaatcgaccatgccctacccttctctcgaacctgggacgactcattcaacaacaaggtactggttctaggcagcgaaaaccagaacaaaggcaaccagacaccctacgaatacttcaacggaaaagacaactcccgcgaatggcaggagttcaaagccagggtagaaacaagccgattcccccgatcgaagaaacaaagaatactcctgcaaaaattcgacgaagacgggtttaaagaaagaaacctcaacgacacccgttacgtaaaccggttcctgtgccaattcgttgccgaccgaatgcgcttaaccggaaaggggaagaaacgcgtattcgcaagcaacggccaaataaccaacctcctgcggggattctggggacttcgaaaagtccgcgcagaaaacgacagacaccacgccctagacgccgtcgttgtcgcttgcagcacggtagccatgcaacaaaagatcacgcggttcgtacgatacaaagagatgaacgcattcgacggcaaaacaatagacaaagagacaggtgaagtcttgcaccagaaaacccacttccctcaaccttgggagttcttcgctcaagaagtaatgatacgggtattcgggaagcctgacggtaaacccgagttcgaagaagcagacacgctagaaaaactgcgaaccctcctcgcggaaaaactttcaagtagacctgaagcagtccatgagtacgtcacgcccctctttgtctccagagcgccaaacaggaaaatgagcggacaaggacacatggaaacggtaaaatccgctaaacgcctcgatgaaggggtctcagtcctccgtgtccccctaacgcaattaaagctcaaagacctcgagaaaatggtcaatcgcgaacgagaaccaaagctatacgaagccctgaaagcaagactggaagcccacaaagacgaccccgccaaggcattcgctgaaccattctacaagtacgataaggcggggaatcgaacgcaacaagtcaaagcagtccgggtggaacaagtccagaaaactggcgtctgggtacgcaaccacaacggcatcgccgacaacgcgaccatggtgcgggtagacgtcttcgagaaaggggacaaatactacctagtcccaatctatagctggcaagtcgcaaaaggaatcctaccagaccgcgcagtcgtccaaggcaaggacgaggaggactggcaattaattgacgacagctttaacttcaaattcagcctccacccgaacgacctcgtggaggtaatcactaaaaaggcacgaatgttcggatactttgcgagctgccaccgcggaacgggaaacatcaatatacggatccacgacctcgaccacaaaatcgggaaaaatgggatactcgaaggcataggcgtaaaaacagccctcagcttccaaaagtaccaaatcgacgaattggggaaagaaatccggccgtgccgcctaaagaaacggccgccagtccgaaaacgcccagccgcaaccaaaaaggccgggcaagcaaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7169 - RNA, 4331 nt, synthetic construct
  misc_feature 1..4331: note = Cas9 variant mRNA product
  source 1..4331: mol_type = other RNA
gggagagtcccgcagtcggcgtccagcggctctgcttgttcgtgtgtgtgtcgttgcaggccttattcaagcttaccatggcccccaaaaagaaaagaaaagtcggtatccacggagtccccgcggcgaagaaaccctatacgatagggctagacatcgggacaaattcagttggttgggcagtgctcacggaccagtacgacctcgtcaaaagaaaaatgaaaatagccggagactcagaaaagaaacagataaagaaaaacttttggggagtacgtctcttcgacgaagggcaaaccgcagcggacaggcgaatggcgcgcacagcacggcggcgcatcgaacggcgacgcaaccggatcagctacctgcaagggatcttcgcggaagaaatgtccaaaacggacgcgaacttcttttgccggctgagcgatagcttttacgtcgacaacgagaaaaggaatagccgccacccattcttcgcgaccatcgaggaagaagtcgaataccacaaaaactatccaactatctaccatctgcgggaagaactcgttaattccagcgaaaaagctgacctacgcctagtctacctcgcgctagcccacatcatcaaataccggggcaactttctcatcgagggcgcgctagatacccagaacacctccgtggacggcatctataaacaattcatccagacatataatcaagtctttgcatcaggcatagaggacggcagtctcaagaaacttgaggataacaaagacgtcgccaaaatactcgtggagaaagtcacgcgtaaagaaaagctagaaaggatcctcaaactataccctggggaaaaatccgccggcatgtttgcccaattcatctcgctaattgtgggcagcaaagggaacttccaaaaaccgttcgacctgatagagaaaagcgacatagagtgcgcgaaagactcctacgaggaagacctcgaatcactactagctctaatcggggacgaatacgcagaactcttcgtggccgccaaaaacgcatactcagcagtagtcctaagctccattatcacggtcgccgagacagaaacgaacgccaaactcagcgcctcgatgatcgagcgtttcgacactcacgaagaggacctcggcgagctaaaggcattcatcaagctgcacctcccgaaacactacgaggagatattcagcaataccgaaaaacacggctacgcgggctacatcgatggaaaaacaaagcaagccgacttttataaatacatgaagatgacgctcgaaaacatcgagggcgcagactacttcatcgccaagatagaaaaagagaacttcctacgcaaacaacggaccttcgacaacggagccatcccacaccagctccacctcgaggagctggaggcaatactacaccagcaagcaaaatactaccccttcctcaaggaaaactacgacaaaataaaatccttggtaaccttccgaatcccctacttcgtcggcccactggccaacggacagagcgagttcgcgtggctcacacgcaaagcagacggcgaaatccgcccatggaacatagaagaaaaagtagacttcggaaagtcagccgtcgacttcatagaaaagatgaccaacaaagacacgtacctgccaaaggaaaacgtcctaccgaagcattccctatgctaccaaaaatacctcgtctacaacgaacttacgaaagtgagatacataaacgaccaggggaaaacatcatacttttccgggcaggagaaagagcagatatttaacgacctcttcaaacaaaaacgcaaagtcaaaaagaaagacctagaactcttcctaaggaacatgtctcacgtagagtcgcccaccatcgaagggctagaggactctttcaactcatcttactccacgtaccacgacctcttaaaagtaggcatcaaacaggaaatactcgacaaccccgtaaataccgaaatgctagaaaacatagtgaaaatactcaccgtgttcgaagacaagcgaatgatcaaggagcaactccaacagttctcggacgtactcgacggggtagtgctcaagaaactagaacgcagacactacaccggctggggcaggctttcagcaaaactcctaatgggaatccgcgataaacaatcacatctgaccatactcgactacctgatgaacgacgatggactcaaccgtaacttgatgcagttaataaacgacagtaaccttagcttcaaatcaatcatcgagaaagaacaagttacaacagcagacaaggacattcagtcaatcgtagccgacctagctggcagccccgccatcaaaaaggggatactacaatcgctcaagatcgttgacgaacttgtctcagtcatgggttacccgccacaaactatagtcgttgaaatggcaagggagaaccagacgacaggaaaaggaaagaacaatagtaggccacgatacaaaagcctggaaaaggccataaaggagttcggctcacaaatcctaaaggaacaccccactgacaaccaggaactacgaaacaaccgcctatacctgtactatctgcaaaacggaaaagacatgtacacgggccaagacctcgacatacacaatctcagtaattacgatatagaccatatcgtaccacagagcttcatcaccgacaactccatcgacaacttagtactcacgagctccgcagggaacagagaaaaaggcgacgacgtaccacccctagagatcgtacgtaaacggaaggtcttctgggagaaactttaccaaggcaatcttatgagcaagcgcaagttcgactatctcaccaaagccgagagaggtggtctaacggaagccgacaaagcgcgattcattcaccgacagctcgtcgagacacgacaaataaccaaaaatgtcgcgaacatcctgcaccagagattcaactacgagaaggacgaccacggaaacaccatgaaacaagtgcgaatcgtgacactgaaatccgcgctcgtatcacagtttcgcaagcaattccaactttacaaggtccgcgacgtaaacgactaccatcacgcacacgacgcctacctcaatggcgtagtcgccaacacactgctcaaagtatacccccaactagaacccgaatttgtctacggagactaccatcaattcgactggttcaaggcgaacaaagcgaccgccaagaaacaattctacacaaacataatgctgtttttcgcacaaaaggaccgcataatcgatgaaaacggcgaaatcctctgggacaagaagtacctcgacaccgtaaagaaagtaatgagctaccgccagatgaacatcgtgaagaaaacagagatacagaaaggcgagttttcgaaagcgacaatcaagcccaaaggcaactcatcgaaactcatacccaggaaaacaaactgggatcccatgaaatacggaggcctagactccccaaacatggcctatgcagtagtcatagaatacgcaaaaggcaagaacaaattggtcttcgagaagaaaataataagagtaacgatcatggaaagaaaagcattcgaaaaagatgaaaaggcattcctcgaggaacaaggttaccgccagcccaaggtccttgccaaacttcctaagtacaccctatacgaatgtgaggaaggccggcgccgcatgctggcaagcgccaacgaagcgcagaagggcaaccaacaagtcttgccaaaccacctagtaaccctactacaccatgcagcaaactgcgaggtgtccgatgggaaatccctcgactatatcgaatcgaacagggaaatgtttgccgaactcctcgcgcatgtcagcgagttcgcaaaacgatacacactggccgaagcgaatttaaataaaataaaccaactattcgaacaaaacaaagaaggcgacattaaagccatagcacaatccttcgtggacctcatggccttcaacgcgatgggagccccagcctcgtttaagttctttgaaaccaccattgaacgcaaacgctacaataacctcaaagaactactcaactcgacaattatctaccaatcaatcaccggcctctacgaatccaggaagagactcgacgacaaacgcccagccgcaaccaagaaggccggtcaggccaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7170 - RNA, 4364 nt, synthetic construct
  misc_feature 1..4364: note = Cas9 variant mRNA product
  source 1..4364: mol_type = other RNA
gggagagtcccgcagtcggcgtccagcggctctgcttgttcgtgtgtgtgtcgttgcaggccttattcaagcttaccatggcccccaagaagaaacgcaaagtaggaatacacggagtcccggccgccaagaaaccatacagcataggactagacatcggaaccaactcggtcgggtgggcggtagtcacagacgactacaaagtgccggcaaagaaaatgaaagtacttggcaacaccgacaaatcccacatagagaaaaacctgctgggggcactactcttcgactccgggaacacagccgaggaccgacgcttgaaacggacagcccgccgtagatacacccggaggcgtaaccgcatcctctaccttcaagaaatattctccgaagagatgggaaaagtggacgacagcttcttccaccgcctagaggactccttcttagtcacggaagacaaacgcggcgagcgacaccccatcttcgggaacctcgaagaggaggtcaagtaccatgagaacttcccgactatctaccatctccgacaatacctcgccgataaccccgaaaaagtagatctccgcctagtgtatctagcgctagcccatataatcaaattccggggacacttcctaatcgaaggaaagttcgacacccgcaacaacgacgtacaacgcctattccaggaatttcttgcggtatacgacaacacattcgaaaactcatctctgcaagaacaaaatgtccaagtcgaagaaatcctgaccgacaaaatctccaaaagcgctaagaaagaccgagtgctcaagctattcccgaacgaaaagtcaaacggaagattcgccgagttcctgaaactcatcgttggaaaccaggccgatttcaagaaacatttcgaactagaagaaaaagccccactacagttctccaaggacacctatgaggaggaactagaagtgctccttgcccagatcggggataactacgctgaactattcctaagcgccaagaaactttacgacagcatcctgctcagcggcatactgacggtcacggacgtcggcaccaaagccccactatccgccagcatgatacaacgatacaacgaacaccagatggacctagctcaattgaagcaattcatccggcagaagttgtcagacaagtacaacgaagtcttcagcgatgtttccaaagacggctacgccggatacatcgacggcaagacaaaccaagaagcgttctacaaatacctgaagggattgctcaacaaaatcgaagggtcgggatacttcctagacaagatagaacgtgaggacttcctaaggaagcaacgtacattcgacaacggcagcatcccccatcaaatccacctacaggaaatgcgcgctatcattcgcagacaagcagagttctaccccttcctagctgacaaccaagaccgcatagaaaagctgctcacctttagaatcccctactacgtaggacccctcgcccgcggaaaatcggacttcgcctggttatcccgcaagagtgccgataaaataacaccatggaacttcgacgagatcgtagacaaagagagcagcgcagaggccttcatcaaccgcatgacaaactacgatctatacctacccaaccaaaaggttctgcccaagcacagcctactttacgaaaagttcaccgtatataacgaactgacgaaagtcaagtacaaaacagaacaaggcaaaacagccttcttcgacgcaaatatgaagcaagagatatttgacggcgtcttcaaagtctatcgcaaagtcaccaaggacaaactcatggacttcctggaaaaagagttcgatgagttccgcattgtcgacctcaccggcctcgacaaagaaaacaaagtattcaacgccagctacgggacctaccacgacctctgcaagatcctggacaaagatttcctggacaacagcaaaaacgagaaaatccttgaagacatcgtactcaccctcaccctcttcgaagaccgcgaaatgatccgcaaacgactcgaaaactactcagacttactaaccaaagaacaagtcaaaaagttagaaagacgccactataccggctggggacgacttagcgccgaactcattcacggcattcgaaacaaggaatcgcgaaaaaccatactggactacctaatcgacgacggaaacagcaaccgcaacttcatgcagctcataaatgacgatgcactcagtttcaaagaggaaatcgccaaagcacaagttatcggggaaactgacaacctcaatcaagtcgtctcagacatagccggaagtccagcgataaagaaagggatcctccaaagccttaaaatcgtcgacgagttagtaaaaataatgggccaccaaccagaaaatatagtagtcgagatggcacgcgaaaaccagttcaccaaccaagggcgaagaaacagccaacaacgactgaagggcctaaccgactccataaaagagttcggcagccagatacttaaagaacacccagtagaaaatagccagcttcagaacgacagattgttcctctactacctacaaaatgggcgcgacatgtacaccggagaggaactcgatattgactatctttcacagtatgacatcgaccacatcataccacaggcctttatcaaagataactctatcgacaaccgggtcctaacctcatccaaggagaatcgaggaaaatcagacgatgtgccttcgaaagacgtagtccgcaaaatgaagtcctactggtctaagctcctatccgccaaacttataacgcaacgaaagtttgacaatctcaccaaagcggagcgtgggggcctcaccgacgacgacaaggccggattcattaaacgacagctagtcgaaaccagacaaatcaccaaacacgtagcccgaatactcgacgaacgcttcaacacagaaacagatgaaaataacaagaaaatccgacaagtgaaaatagtcacccttaaaagcaacctagtatccaacttccgaaaagagttcgaactctacaaagtacgcgagatcaacgattaccaccacgcacacgatgcctacctcaacgccgtgatcgggaaagcgctcctaggcgtatacccccagctagaacccgagttcgtgtacggcgactacccacacttccacggacacaaggaaaacaaggcaaccgcgaagaaattcttttacagcaacatcatgaacttcttcaagaaagacgacgtacgaacagataaaaacggcgaaataatctggaagaaagacgagcacatttccaatattaagaaagtactgtcgtatccgcaagtgaacatagtgaagaaagttgaagaacaaacgggaggcttttccaaagagtcgatactgccgaaaggaaactcagacaaacttataccaaggaaaacgaagaaattttactgggacaccaagaaatacggcggcttcgattcacccatcgtagcctacagcatcctagttatcgccgacatagagaaaggcaaaagcaagaaactaaaaacggtcaaagctctggtaggagtaactatcatggagaaaatgaccttcgaacgcgacccggtcgcctttctggagcgcaaaggttaccgcaacgtccaagaggaaaatataatcaaactgcccaaatatagtctatttaaactggagaacggccgcaaaagactactcgcatcagcgcgggaactccaaaaaggcaacgagatagtactcccaaaccacctcggtacactcctataccacgcaaagaacatacataaagtagacgaaccaaagcacttggactatgtagataaacacaaggatgagttcaaagagcttctagacgtcgtaagcaacttctctaagaaatacaccctggcagagggcaacctcgagaaaataaaggagctgtacgcccaaaacaacggcgaggacctcaaggagcttgccagctcattcatcaatctcctcacattcactgcaataggcgcaccagccactttcaagttctttgataagaacatagaccgaaagcgctacacatcaaccacagagatcctcaacgcaacgctcatacaccaatcaatcacaggcctatacgagacccgcatcgacctcaacaagctcggaggagataagcgtcccgccgcaaccaagaaagcaggacaagcgaaaaagaaaaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7171 - RNA, 3497 nt, synthetic construct
  misc_feature 1..3497: note = Cas9 variant mRNA product
  source 1..3497: mol_type = other RNA
gggagagtcccgcagtcggcgtccagcggctctgcttgttcgtgtgtgtgtcgttgcaggccttattcaagcttaccatggcccccaaaaagaaacgaaaagtcggaatccacggtgtacccgccgcccaaacaaccaacctcagctacatactcggcctggacctaggcatcgcatccgtaggctgggccgtcgtagaaatcaacgaaaacgaggatccaatcggactcatcgacgtcggagtacgcatcttcgaaagggctgaagtcccaaaaacaggagagtcgctagccctcagcagacgcctggcacgatcaacacggagacttattcgacgccgagcccaccgactcctcctagcgaaacgattcctaaaacgcgaagggatccttagcaccatcgacctcgaaaaaggactcccaaaccaggcatgggagctccgagtagcaggactggagcgaagactatctgcgatcgaatggggtgcggtactcttacacctcataaaacaccgcggatacctaagcaagcgaaagaacgaatcccagacaaacaataaagaactgggcgcactgctcagcggagtcgcacaaaaccaccagctcctgcagtccgacgactaccgaacccccgccgaactagccctcaaaaagtttgctaaagaggaaggacacattcgaaaccaaagaggagcctacacgcacaccttcaacagactagatctactagccgagctgaacctattgttcgcacagcaacaccaatttggcaaccctcattgcaaagagcacatacagcagtacatgacagaactcctcatgtggcaaaaaccagccctcagcggcgaggcaatcctcaaaatgctgggaaagtgcacacacgagaaaaacgagttcaaagccgcaaagcacacctactcagcagaaagattcgtctggctcaccaaactaaacaacctccgtatattagaagacggtgcagaacgcgcgctgaacgaagaagaacgacaactcctaataaaccacccctacgagaaaagtaaactaacctacgcccaagtacgcaaactgttagggctcagtgagcaagccatattcaaacacctccggtactcaaaggaaaacgcggaaagcgccaccttcatggaactgaaagcctggcacgccatacgcaaagccctggaaaaccagggactaaaagatacatggcaagatctagcaaagaaaccagacttactcgacgaaattggcactgcattctctctgtacaaaacggacgaagacatccagcaatacctaaccaacaaagtcccaaactccgtaataaacgctctcctagtctccctcaacttcgacaaattcatcgaactcagcctaaaatcactacgcaaaatcctgcccctgatggaacagggcaaacggtacgaccaagcctgccgagaaatatacgggcaccactacggagaggccaaccagaaaacctcacaactcctaccagccatacccgcccaagaaatacgcaacccggtagtcctacgtaccctctcacaagcccgcaaagtaataaacgcaataatccgacaatacggatcaccagcgcgcgtgcatatagaaacaggccgagagctgggaaagtccttcaaagaacgacgcgaaatccaaaaacaacaagaagacaacaggacaaagcgggaaagcgccgtccaaaaattcaaggaactcttctccgacttcagttccgaaccaaaaagcaaagacatcctaaaattccggctttacgaacagcagcacggcaaatgcctatactcagggaaagagataaacatacaccgtctcaatgagaaaggctacgtagaaatagaccacgccctccccttcagccgcacatgggacgactcattcaacaacaaggtgctagtgttagcatcagaaaaccaaaataaaggcaaccagacaccctacgaatggctccagggcaagataaactccgagcgatggaaaaacttcgtggccctagtactcggttcacagtgctctgcggccaagaaacagcgactcctcacacaagtcatagacgataacaaattcatcgaccgcaacctgaacgacacaagatacatagcccgcttcctgtccaactacatccaagaaaaccttctcctagtagggaaaaacaaaaagaacgtattcactccaaacggccaaatcacagccctactacgaagccgctgggggcttatcaaggcacgtgaaaacaacaaccgccaccacgccttagacgccatcgtggtcgcctgcgcaacacctagcatgcaacagaaaatcactcgatttatcagattcaaggaagttcacccctacaagatagaaaaccggtacgagatggtagaccaagaatccggagaaatcataagccctcacttccccgaaccctgggcttacttccgccaagaagtaaacatacgagtgttcgacaaccaccccgatacagtcctcaaagaaatgctcccagatcggccacaggccaaccaccaatttgtacaacccctcttcgtctcccgagccccgaccagaaaaatgtccggccaggggcacatggaaaccatcaaatcagcgaaacgactggccgagggcatcagtgtgctgcgtatacccctaacccagctcaaaccaaacctcctcgaaaacatggtaaacaaggagcgagagccagccctgtacgcaggactaaaagccagactcgcagagttcaaccaagatccagcgaaggccttcgcaacacccttctacaaacagggaggccaacaggtgaaagcgataagagtcgaacaagtccaaaaatccggagtcctcgtccgagaaaacaacggggtcgcggacaacgccagcatcgtaagaaccgacgtattcatcaaaaacaataaattcttcctcgtcccaatctacacctggcaggtcgccaaagggatccttccaaacaaagctatcgtggcccacaaaaacgaagatgagtgggaagagatggacgaaggagcgaaattcaagttctcacttttccccaacgacctcgtggaactcaaaaccaagaaagagtacttcttcggatactacatcggtctcgaccgagccaccgggaacatctctctgaaagaacacgacggcgaaatttccaaaggaaaagacggcgtataccgggtcggggtcaaactcgcactgtcgttcgagaaataccaggtcgacgagttggggaagaaccgtcaaatatgccgaccacaacaaagacaacccgtacgaaaacgacccgcggccacaaagaaagctggacaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7172 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcaccgaaaaagaaacgaaaagtgggcattcacggagtaccggcagcggccgcattcaaacccaacccaattaactacatcctcggactcgacatcggcatagcaagcgtcggatgggccatggtcgaaatcgacgaggacgaaaaccccatatgcctaatagaccttggtgtccgcgtattcgagcgagccgaagtacccaaaaccggggacagcctcgcgatggcgcgcaggctcgcccgatctgttaggagactcacccgacgccgtgcccaccgcctactccgtgcacgccgactactcaaaagagaaggcgtgctccaagccgcagacttcgacgaaaacgggctcatcaaatcgctccccaacactccctggcagttaagagccgctgcactggatcgaaaactcacgccactagaatggtccgccgtactcctccacctaatcaagcaccggggctacctgagccaacgtaagaacgagggcgagaccgcggacaaagaactaggagcgctgctaaaaggagtcgccgacaacgcgcacgccctccaaacgggagatttccgcacccccgccgagctcgccctaaacaaattcgagaaagaaagcggacacatacgaaaccaaagaggcgactacagtcacacattcagccgaaaagacctccaagccgagctaatcctactcttcgagaaacaaaaagagttcgggaacccccacgtctccggagggctaaaagaaggaatagaaacactcttaatgacacaaagaccagcgctatcaggagacgccgtccagaaaatgctcggccattgcacctttgaacctgccgaaccaaaggccgccaaaaacacatacaccgcagagagattcatatggctaaccaaacttaacaatctccgcattctagaacaaggctcagaacgaccactaaccgacaccgaacgagcgaccctgatggacgaaccataccgcaagtcaaaactgacgtatgcacaagcccgcaaactcctcggcctcgaagacacagccttcttcaaaggcctaaggtacggaaaagacaacgccgaagcctcgacactcatggagatgaaggcgtaccacgcaatatcccgagccctcgaaaaagaaggcctcaaggacaagaaaagccccctcaacctttcgccagagctacaagacgaaataggcacggcgttcagcctcttcaaaaccgacgaagacataaccggccgcctaaaagaccgcatacaaccagaaatcctcgaagcactcctgaaacacatctcattcgacaaattcgtacagatcagtctgaaagcactgcgacgcatcgtacccctgatggagcaaggtaaaaggtacgacgaagcatgcgccgagatctacggagatcactacggcaagaaaaacactgaagagaaaatctacctaccccctatccccgccgacgaaataagaaaccccgtggtgctacgcgccctcagccaagcacgaaaagtgataaacggcgtcgtacggcgctacggatcacccgcccgaatacacatagaaacagcccgagaggtcggcaaatcattcaaagaccgcaaggaaatcgagaagcgacaagaagaaaaccgaaaagaccgcgagaaagcggccgcaaaattccgggaatacttccccaacttcgtcggagaaccaaaatcaaaagacatactaaaactcaggctatacgaacagcagcacggaaaatgtctatactcgggaaaagaaatcaacctcggacgactaaatgaaaaaggctacgtagagatagatcacgcgctaccgtttagccgcacctgggacgacagcttcaataacaaagtactcgtactaggatccgaaaaccagaacaaaggcaaccaaaccccgtacgagtacttcaacggcaaagacaactcacgagaatggcaagagttcaaagcaagagtagaaacgagcagatttccacgatcaaagaaacaacgaatcctacttcaaaaattcgacgaagacggattcaaagaaagaaacctaaacgacaccaggtatgtaaacagattcctctgtcaattcgtagccgacagaatgcgtctcactgggaaaggaaagaaacgagtcttcgcaagcaacggacagatcacaaatttgctccgaggattctggggcctccgaaaagtcagagcagaaaacgaccgccaccacgctctagatgccgtagtggtcgcttgcagcacggtagcgatgcaacagaaaatcacacgattcgtccgatacaaagaaatgaacgcattcgatggtaaaactatcgataaagaaacaggagaggtacttcaccaaaagacccacttcccccaaccctgggagttcttcgcccaagaagtcatgatccgagtcttcggaaaacccgacgggaaacccgagttcgaagaagcagacaccccagaaaaactacgaaccctactcgcagaaaaacttagctctagacccgaagccgtccacgaatacgtcactccactattcgtgtcacgcgctcccaacagaaaaatgagcggccaaggacacatggagacagtaaagtccgccaagcgactcgatgaaggagtctccgtcctgcgagtacctctcacccaactaaaattgaaagacctcgaaaagatggtaaaccgcgaacgagaaccaaagttatacgaagcgctgaaagcccgactcgaagcccacaaagacgacccagccaaagcattcgccgaacccttctacaaatacgacaaagccggcaaccggacacaacaagtaaaagccgtccgggtggagcaagtacagaaaacaggcgtctgggtacgaaaccacaacggaatagcggacaacgccaccatggtccgcgtagacgtatttgagaaaggcgacaaatactatcttgtcccgatatactcgtggcaagtcgcaaagggcatcctcccggatcgggcggtagtacagggcaaagacgaagaagactggcaactcatagacgactccttcaactttaagtttagtctacaccctaacgatctcgttgaagtaatcaccaagaaagcacgcatgttcggctacttcgcgagctgtcatagaggcacgggcaacatcaacatccgaatccacgacctagaccacaaaattggcaaaaacggaatcctagagggcatcggagtcaaaacagctctgtccttccaaaaatatcaaatcgacgaactcggcaaagaaatacgcccgtgtcgactcaagaaacgacccccagtccgaaaacgaccagcagcaaccaagaaagcaggacaagcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7173 - RNA, 3581 nt, synthetic construct
  misc_feature 1..3581: note = Cas9 variant mRNA product
  source 1..3581: mol_type = other RNA
gggagagtcccgcagtcggcgtccagcggctctgcttgttcgtgtgtgtgtcgttgcaggccttattcaagcttaccatggcacccaaaaagaaaagaaaagtaggcatacatggcgtccccgcagcaaaatatcatgtgggaatagatgtcgggacattctccgtgggcctcgcagcaatcgaagtcgacgatgccggaatgcccataaaaactctctcacttgtctcgcacatccacgacagcggcctcgaccccgacgaaataaaatccgcggtaacacgactcgcatccagcggcatcgcacgcaggacaagaagactctacaggagaaaacgccggagattacagcaactggacaaattcatacagagacaaggatggccagtgatcgaactagaagattactcagaccccctatatccctggaaagtccgcgcagaactcgccgcctcctacatcgcagacgaaaaagaacggggcgaaaaactaagcgtagcactccgccatatagcacgccaccggggatggcgcaacccctacgccaaggtatcaagcctgtatctcccggacggcccgtccgacgcattcaaagccatacgagaagagattaaacgagccagcggacaaccagtaccagagacagccacagtcggccagatggtcacgctttgcgaattaggaaccttaaaacttaggggcgaaggaggagtactctcagcccgacttcaacagtccgactacgctcgtgaaatacaagagatctgccgcatgcaagaaatagggcaggaattatacagaaaaataatcgacgtagtattcgcagcagagagccccaagggatccgcaagcagcagagtaggaaaggacccactccaacccgggaaaaacagagcgctaaaagccagcgacgcattccagagataccgaatagcggcactgataggaaaccttagggtacgtgtagacggagaaaagcgaatactaagcgtcgaagagaaaaaccttgtattcgaccacctggtaaatttaaccccaaagaaagaaccagaatgggtaacaatagccgaaatacttggcatcgacagaggacaacttataggcaccgcgactatgacagacgacggagaacgagcaggagctcggcccccaacacacgacacgaaccgctcgatcgtaaattcacgcatcgcacccctagtagactggtggaaaacggcaagcgcactagagcaacacgccatggtcaaagcactatcaaatgcagaagtcgacgacttcgacagcccggagggagcaaaagttcaagccttcttcgcagacctagacgatgacgtacacgcgaaactcgatagtctccacctcccagttggtcgcgccgcatacagtgaagacacactcgtccgactaacacgcagaatgctttccgacggcgtagacctttacacggcacgattacaagagttcggaatcgaaccaagttggacaccacccacacccaggataggggaaccggtcggaaatccagccgtggacagagttctaaaaacagtatcgagatggctagaaagtgcgaccaaaacatggggcgccccagaacgggtaattatagaacatgttagagagggattcgtcaccgagaaaagagcaagggaaatggacggtgatatgaggcgacgcgcagcaaggaacgcaaagctatttcaagaaatgcaggaaaagctcaacgtacaaggaaagccaagccgcgccgacctctggcgctaccaatccgtacagcgccaaaactgtcaatgtgcgtactgtggaagccccatcaccttcagcaactcagaaatggaccacattgtaccgagagccggacaaggctcaaccaacaccagagaaaacctagtcgccgtatgccaccggtgtaaccaaagcaaggggaacacccctttcgcaatatgggcgaaaaacacaagcatcgaaggagtatccgtaaaggaagcagtggaaagaacacgccattgggtcacagacaccgggatgagaagcacagacttcaaaaagtttaccaaggcagtagtcgaacgcttccaaagagccacaatggacgaagagatcgacgccagatccatggaatcagtggcatggatggccaacgaattaaggagccgggtggctcaacactttgcatcacatggaactaccgtacgggtatacagaggaagcctaaccgcagaagcccgccgagcctccggcatctccggaaagctcaaattcttcgacggcgtaggaaaatcccggctggatcggcgccaccacgccatcgatgcggccgtaatagccttcacatccgactatgtggcagaaaccctagcagtccgtagcaacctcaaacagtcgcaagcacaccggcaagaggcaccccaatggagggagttcaccggcaaagacgccgaacaccgggccgcctggcgcgtctggtgccagaaaatggaaaagctaagcgccctactaacggaggacctccgggatgacagagtagtagtgatgagtaacgtccgactcagactaggaaacggctcagcacacaaggaaactataggcaaactatcaaaagtcaaactctcatcgcaactaagcgtttcagacatcgacaaagcctccagcgaagcactatggtgcgcactcaccagagaacccggctttgacccgaaggaaggtttgccggcaaacccagaaaggcacattcgagtaaacggcacccacgtctacgccggcgataacatcggactcttccctgtttccgcggggtctatcgctctaaggggcggctacgcagaactcggaagctccttccaccacgcgcgagtatacaaaatcacatccggcaagaaaccagcattcgccatgctgcgcgtctacacaatagaccttttgccctaccggaaccaagacctctttagcgtggaactaaaaccgcaaactatgtcaatgcgccaagcagaaaagaaactccgggatgctctagcaaccggaaacgcggaatatctcggctggctggtggtggacgacgagctagtagtcgacacgtcgaaaatagcaacagaccaagtgaaagcagtagaagcagaactagggacaatacggcgatggcgagtcgatgggttcttcagcccctcaaaactcagactaagaccactccaaatgagcaaagaagggataaagaaagaatccgccccagaactgtcaaaaataatagatagaccaggctggcttccagcagtcaacaaactcttctcagatggcaacgtcacagtcgtaagacgggactcattaggtcgagtccggctcgaatcgacagcccatctgcccgttacatggaaggtacagaagcgccccgcagccacaaagaaagccggtcaagctaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7174 - RNA, 3281 nt, synthetic construct
  misc_feature 1..3281: note = Cas9 variant mRNA product
  source 1..3281: mol_type = other RNA
gggagagtcccgcagtcggcgtccagcggctctgcttgttcgtgtgtgtgtcgttgcaggccttattcaagcttaccatggcgccgaaaaagaaacgcaaagtcggaatacacggagtacccgcggccgcccgtatcctcgccttcgacatcggtatatcctcgatcggctgggcattctccgaaaacgacgaactcaaagactgcggcgtacgcatattcacaaaagtagaaaatccgaagaccggggaatccctcgcactcccacgcagactggcgcgaagcgcccgcaaacgcctcgcacgccggaaagcgagactcaatcatctcaaacatctcatcgccaacgagttcaagctaaactacgaagactaccagtcgttcgacgaatccctcgcgaaagcctacaaaggcagcctaatctccccttatgaactgcgcttccgagccctaaacgaactgctgagcaaacaagacttcgcccgggttatccttcatatcgcgaaacgacggggctacgacgacatcaaaaactcagacgacaaggaaaagggagcgatactcaaggcgataaagcaaaacgaagaaaaactcgccaactaccagtcagtcggagagtacctctataaagaatattttcaaaagtttaaagagaactccaaggagttcacgaatgtcagaaacaaaaaggaaagctacgaacggtgcatagcccagtcctttctgaaagacgagttaaagctcatcttcaagaaacagcgggagttcgggttctcgttctccaagaaattcgaggaagaagtcctctcagtcgctttctacaaaagagcactaaaagacttcagccacctcgtaggaaactgctccttcttcaccgacgaaaaacgcgcccccaaaaacagcccactcgcgttcatgttcgtcgccttaacacgcatcatcaacctcctaaacaacctcaaaaacacggaaggcatcctatacacgaaagacgacctcaacgcgctactgaatgaggtcctaaagaacggaaccttaacctacaaacaaacgaaaaagctactcggtctttcggatgactacgagttcaaaggggaaaaaggcacctacttcatcgagttcaagaagtacaaggaatttattaaagcactaggcgaacacaatctgtcacaagatgacctcaacgaaatcgcaaaagacatcaccctgatcaaagacgaaatcaagctaaagaaagcgcttgccaaatacgacctcaaccaaaaccaaatcgacagcctttccaaactagaatttaaagaccaccttaacatcagctttaaagcactaaagctagtaacacccctaatgctcgaaggtaaaaagtacgatgaggcctgtaacgaactgaacctgaaagtcgccattaacgaagacaaaaaggacttcctacccgccttcaacgagacatattacaaagatgaagtgaccaatcccgtggtactacgcgccatcaaagagtacagaaaggtactgaacgctttactcaagaaatacggcaaagtacacaaaatcaacatcgaactcgcacgtgaagtcggcaaaaaccactcccagcgcgccaaaatagagaaagaacaaaacgaaaactacaaagccaagaaagacgccgaactagaatgcgaaaaactcggactcaaaatcaactccaaaaacatcctaaaactccgcctcttcaaagaacaaaaagagttctgcgcctacagcggagagaagatcaaaatcagcgacctgcaggacgagaagatgctggaaatcgaccacatctacccctacagccgcagcttcgatgattcctacatgaacaaggtactcgtattcacaaaacagaaccaagaaaagctcaaccaaacaccattcgaggccttcggcaacgacagcgcaaaatggcaaaagatcgaggtcctagcaaagaacctaccaaccaagaaacaaaaacgcatactagacaaaaactacaaggacaaggaacagaaaaacttcaaggatcgcaacctgaacgacacgcgatacatagcacggctcgtgctcaactacaccaaagactacctcgacttcctacccctaagcgacgatgaaaacacaaagctcaacgacacccagaaaggctcaaaagttcatgtagaagcgaaaagcggaatgctaacctccgccctcaggcacacgtggggattcagcgcgaaagacagaaacaaccacctacaccacgccatcgacgcggtcatcatcgcgtacgcaaacaattctattgtcaaggcattctcggacttcaagaaagaacaagaatccaactcggccgaactctacgcgaaaaagatctcggagctagactacaaaaacaaacgaaaattcttcgaacccttcagcggtttcaggcaaaaagtcctggacaaaatagacgagatattcgtctccaagccagagcgaaagaaacccagcggagcactgcacgaagaaaccttcaggaaagaagaagaattttaccaatcctacggcggtaaagaaggggtgctcaaggcactcgagctaggcaaaatacgcaaagtaaacggcaagatcgtcaagaacggagacatgttccgggttgacatattcaaacacaagaaaaccaacaaattctatgcagtcccaatctatacaatggacttcgcactcaaagtcctgccaaacaaagctgtcgcgcgcagcaagaaaggcgaaattaaagactggatacttatggacgagaactacgagttctgcttttccctctataaagactcactaatactcatccagaccaaagacatgcaagaaccggagttcgtctactacaacgccttcacgagcagcaccgtcagcctaatcgtatcaaaacacgacaacaaattcgaaactctgtcgaaaaaccagaaaatcctcttcaaaaacgccaacgaaaaagaggtgatcgcgaagtctattggcattcaaaatctcaaggtgttcgagaaatacatcgtcagtgccctgggagaagtcaccaaggcagagttcagacagcgggaagacttcaagaagaaacgcccggccgcaacaaagaaagccgggcaagcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7175 - RNA, 3692 nt, synthetic construct
  misc_feature 1..3692: note = Cas9 variant mRNA product
  source 1..3692: mol_type = other RNA
gggagagtcccgcagtcggcgtccagcggctctgcttgttcgtgtgtgtgtcgttgcaggccttattcaagcttaccatggcccccaaaaagaagcgaaaagttggaatacatggcgtcccagccgcctccgacctcgtgctgggcctagacatcgggatcggaagcgtaggagtcggcatcctaaataaagtaacaggagaaatcatccacaaaaactcacgaatcttcccagcagcccaagcagaaaacaacctagtcagacgcacaaaccgccaagggcgtcgattagcccgacgcaagaaacaccgcagggtccgcctaaaccgcctctttgaggaaagtggcctaatcacggactttaccaagatttcaatcaaccttaacccgtaccaactacgagtcaaagggctcacagacgaactaagcaacgaagaattattcatagcactcaagaacatggtaaagcatcgcggcatctcgtacttggatgacgccagcgacgacggtaactcctcggtcggagactatgcccaaatcgtgaaagaaaactccaaacaacttgagacaaaaacaccaggccaaatccaactagaacgctaccaaacctacggccagctcagaggagatttcaccgtcgagaaagacggcaagaaacaccgcctcataaacgtcttccccacctccgcgtaccggagcgaagccctgcgtatcctccaaacacaacaggaatttaacccacaaatcaccgacgagttcataaacagatacctagaaatccttacggggaaacgcaaatactaccacggccccggcaacgagaaaagccgcaccgactacggacgctacaggacatcaggcgaaaccctggacaacatatttggaatactcatagggaagtgcaccttctacccagacgagttccgagccgccaaagctagctacaccgcccaagagttcaacctcctcaacgacctaaacaacctcaccgtgcccacagaaaccaagaaactcagcaaagaacagaaaaaccaaatcatcaactacgtcaaaaacgaaaaagctatgggtcccgcaaaactcttcaaatacatagcaaaactcctaagctgcgacgtagccgacataaaaggatacaggatagacaaaagcggcaaggccgaaatccacaccttcgaagcctaccggaaaatgaaaaccctggaaaccctcgacatcgaacaaatggaccgcgaaacactggacaaattagcctacgtactgacccttaacactgaacgagagggaatccaagaagccctcgagcacgagttcgccgacggcagtttctcgcaaaaacaagtagacgaactcgtgcaattcagaaaagcaaattccagcatcttcggaaaagggtggcacaacttcagcgtgaaactgatgatggaactcatccccgaactctacgaaacctcagaggagcaaatgacaatcctgacacgcctgggcaaacagaaaaccacgagcagcagcaacaaaacaaagtatatcgacgagaaactgctaaccgaagaaatatacaaccccgtcgtcgccaagagcgtaagacaagcgatcaaaatcgtcaatgcggcgatcaaagaatacggcgacttcgacaacatcgtaatcgaaatggcccgggaaacgaacgaagacgacgagaaaaaggccatccagaaaatccaaaaagcaaacaaggacgagaaagacgccgcgatgcttaaagcggcgaaccaatacaacggcaaggccgaactcccacacagcgtattccacggacacaaacaactagccacaaaaatccgactatggcaccaacaaggcgaacgctgcctatataccggcaaaacaatctcaatccacgacctcatcaacaacagcaatcaattcgaggtggaccatatcctacccctatcaataacattcgacgacagcctggcaaataaagtactcgtatacgccaccgcaaaccaggaaaaaggccaacgcaccccgtaccaagccttggactccatggacgacgcctggagctttagggagctgaaggcctttgtcagggagagcaagacacttagcaacaaaaagaaagagtacctcctaacagaggaggacatctcaaagttcgacgtaagaaagaaatttatagaacgcaacctggttgacacgcgctacgcctcaagagtcgtactcaacgccctccaagaacacttcagagcccataaaatcgacaccaaagtatccgtcgtccgcggccagttcacaagccagctcagaaggcactggggcatcgagaaaaccagagatacctaccaccaccacgccgtagacgcactgatcattgccgcctcctcgcaactcaacctatggaagaaacagaaaaacaccctagtcagctattcggaagaccaactactcgacatcgagacgggcgaacttatatcagatgacgaatacaaagagtctgtattcaaggctccgtatcaacacttcgtggacaccctcaaaagcaaagagttcgaagactcgatcctgttctcctaccaagtggactccaaattcaaccgaaaaatctccgacgccacgatctacgcaacacgccaggcgaaagtaggcaaagacaaagcggacgagacctacgtactcggaaaaataaaggacatctatacccaagacgggtatgacgccttcatgaaaatctacaagaaagacaaaagcaaattcctcatgtaccgtcacgacccccagacattcgagaaagtcatcgagcccatcctagaaaactaccccaacaagcaaatcaacgaaaaaggcaaagaagtaccatgcaaccctttcctaaaatataaagaggaacatggctacattcgaaaatacagcaagaaaggaaacggaccagaaataaaatcactaaagtactacgacagtaaactaggcaaccacatcgacatcaccccgaaagacagcaataacaaggtcgtactacaaagtgtcagtccctggcgagcggatgtttatttcaacaagaccacagggaagtacgaaattctcggacttaaatacgcagacctccaattcgaaaaagggaccggaacctacaagataagccaagaaaaatacaacgacatcaagaagaaggagggggtagactcagactcggagttcaaatttacactgtataaaaatgacctgctgctagtaaaagacacagaaaccaaagaacagcaactattccgcttcctaagcagaactatgcccaagcaaaaacactacgtggaactaaaaccctacgacaaacaaaagtttgaaggcggagaagccctcatcaaagtcctcggaaacgtcgcgaactccggccaatgcaagaaaggactaggaaaaagcaacatttctatctacaaagttcgaacagacgtactaggaaaccaacacataatcaaaaacgaaggagacaaaccgaaattagacttcaagcgccccgcagccaccaaaaaggccggccaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7176 - RNA, 4250 nt, synthetic construct
  misc_feature 1..4250: note = Cpf1 variant mRNA product
  source 1..4250: mol_type = other RNA
gggagagtcccgcagtcggcgtccagcggctctgcttgttcgtgtgtgtgtcgttgcaggccttattcaagcttaccatggcacccaaaaagaaacgaaaagtcgggattcacggagtccccgcagcaacgcaattcgaaggatttacgaacctctaccaagtatcgaaaacactccgcttcgagttaatcccccagggaaaaacactaaaacacatacaggaacaaggattcatagaagaggacaaagcacgcaacgatcactacaaagaactaaaaccgatcatagatcgaatttacaaaacgtacgccgatcaatgcctacaactcgtgcaactcgactgggaaaatctttccgccgcaattgactcatatagaaaagagaaaacggaagaaacccgaaacgctctaatagaggaacaagctacgtaccgtaatgccatacatgactacttcataggccgcacagacaacctcaccgacgccatcaacaagcgccacgcagagatctataaaggactctttaaggcggaactattcaatggaaaagtcctcaaacaactggggacagttactacgaccgaacacgagaacgctctcctgcgctcattcgacaaattcacaacttacttctcagggttctacgaaaaccgcaaaaacgtattctcagcagaagacatctccaccgccatcccgcaccgcatagtgcaagacaacttcccaaagttcaaagaaaactgccacatcttcacacgccttataaccgccgtcccatctctacgcgaacacttcgagaacgtcaagaaagccatcggcatcttcgtctcgaccagcatcgaggaagtcttctcattcccgttctacaaccagctcctcacccaaacacaaatcgacctgtacaatcagctcctcggagggatatccagagaagccgggacagaaaagattaaaggactcaacgaagtcctcaatctagcaatccagaaaaacgacgaaaccgcgcatatcatcgcatccctcccccataggtttatccccctattcaaacaaatcctgtccgaccgcaacactctgtctttcattctcgaagagttcaaatccgacgaggaagtaatacaatccttctgcaaatataagactcttctaagaaacgaaaacgtgttagaaaccgcagaagcactctttaacgaacttaactccatcgacctgactcacatcttcatcagccacaagaaactggagacaatcagctccgcactctgcgaccactgggataccctccgaaacgcactctacgaacgcagaatctccgagcttaccggcaaaatcaccaaaagcgcaaaagaaaaagtgcaacgatccttaaaacacgaagatataaacctccaagaaatcatcagcgcggccgggaaagagttgagcgaagccttcaaacagaaaacctccgaaatcctaagccacgcccacgcagcactcgaccaaccccttcccaccaccctcaagaaacaagaagaaaaagaaatactgaaaagccagcttgactccctacttggattataccacttgctagactggttcgccgtcgatgaaagcaacgaagtcgaccccgagttctccgcacggctcaccggaattaaactcgaaatggaaccaagccttagcttctacaacaaagcacgcaactacgcaaccaagaaaccctacagcgtagaaaaattcaaactaaatttccagatgcccacactggcctcagggtgggatgtaaacaaagagaaaaacaacggagcgatattattcgtgaaaaacggcctttactaccttggaatcatgcccaaacagaaaggccgctacaaagcgctctccttcgaaccgacagagaaaacctctgaaggattcgacaaaatgtactacgactacttcccagacgccgccaaaatgatcccaaaatgctccacgcaactcaaagccgtcaccgcccatttccagacgcatacaacacccatcctcctgtcaaacaacttcattgaaccgcttgaaataaccaaagaaatctacgacctcaacaatccagaaaaggaaccaaagaaattccaaaccgcatacgccaagaaaacgggcgaccagaaaggctatagagaagctctatgcaaatggattgacttcacgcgggatttcctgtccaaatacacaaaaaccacctcaattgacctaagttcgctccgaccctccagtcaatacaaagacctaggggaatactacgccgaactcaacccccttctataccacatctccttccaacgcatcgcagaaaaggaaatcatggacgccgttgaaaccggcaagctatacttgttccagatctacaacaaggacttcgccaagggacaccacggcaaaccaaacctacataccctctactggaccggactattcagccctgaaaatcttgctaaaacgtccataaaactcaacggccaagctgaacttttctaccgtcccaaatcgcgcatgaaacggatggcccaccgactcggcgagaagatgttaaacaagaagttgaaagaccaaaagacaccaatccccgacacactgtatcaggaactctacgattacgtaaaccatcgtctctctcacgacctctccgacgaggcccgcgcgctcctccctaatgtcattaccaaggaagtatcacacgaaatcataaaggaccgccgttttacctcggacaaatttttcttccacgtgccaatcacactcaactaccaggccgccaacagcccttcaaaattcaaccagcgtgttaacgcctaccttaaagagcaccccgagactcccataatcggcatcgaccgcggagaaaggaacctaatatacattaccgtcatagactccacgggtaaaatcctggaacagcggtccctcaacaccatacaacaattcgactaccagaagaaactagacaaccgagaaaaagagcgagtagcagcccgacaagcctggtccgtcgtgggtaccatcaaggaccttaagcaggggtacctcagtcaagttatccacgaaattgtagacctcatgatccactaccaagcggttgtcgtcctggagaacctgaatttcgggttcaaatcaaaaagaaccggcatcgccgaaaaagctgtctaccaacaattcgagaaaatgctaatcgacaaactaaactgcctagtactgaaagactacccagccgaaaaagtcggcggagtccttaacccataccaactaaccgatcaattcactagcttcgcaaagatgggaacgcagtcgggattcctcttttacgttccggccccctatacctccaaaatcgacccccttaccggcttcgtagacccgttcgtctggaagacgattaaaaaccacgaatcaagaaaacactttctagaaggcttcgacttcctgcactacgacgtaaagacaggagatttcatactgcacttcaaaatgaaccgcaatttgtccttccaacgagggctccccgggtttatgccagcgtgggacatcgtcttcgagaaaaacgaaactcaattcgacgctaaaggcaccccatttatagccggcaaacgtatcgtaccagtcatcgaaaaccaccgcttcaccggccgttacagagatctctaccccgcgaacgagctaatagcactactggaggaaaaaggaatagtcttcagagacggcagcaacatccttccaaagctgctagagaacgacgactcccacgccatcgacacgatggtcgccctcatccgatccgtgctccaaatgcgaaactccaacgcagccacgggagaggactacataaacagtcccgtccgagacctaaacggcgtctgcttcgactctcgcttccagaacccagaatggcccatggacgctgacgccaacggcgcgtaccacatcgccctcaaaggccagctcctactaaaccaccttaaggagagcaaagacctcaaactgcaaaacggcatcagcaaccaggattggctcgcctacatccaagaactaaggaacaaacgacccgcagctacaaagaaagctggccaagctaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7177 - RNA, 4229 nt, synthetic construct
  misc_feature 1..4229: note = Cpf1 variant mRNA product
  source 1..4229: mol_type = other RNA
gggagagtcccgcagtcggcgtccagcggctctgcttgttcgtgtgtgtgtcgttgcaggccttattcaagcttaccatggcaccgaagaagaagcgaaaggtgggcattcatggggtgcctgcggcatccatataccaagaatttgtaaacaaatactccctctctaaaacactccgcttcgaactaatcccccagggtaaaaccctggaaaatatcaaagcgcgcgggctcattctagacgacgagaaacgcgcaaaggactacaagaaagctaagcaaatcatcgataaatatcatcaatttttcatagaagagatcctctccagtgtctgcataagtgaggacctcctccaaaactactcggacgtttacttcaagctcaagaaatcagacgacgacaacctccagaaagacttcaagagcgcgaaggataccattaagaaacagatctccgaatacataaaagactccgaaaaattcaaaaacctctttaaccaaaacctgatcgacgcgaagaaaggccaggaatcagacctaatactatggctaaaacaatcaaaagataacgggatcgaactcttcaaagccaacagcgacatcaccgacatcgacgaagcgctagagataataaaatccttcaagggctggaccacctacttcaagggattccacgaaaaccgcaagaacgtatactcaagcaatgacatccccacgtccataatctaccgcatcgtggacgacaacctcccaaagttcctcgaaaataaagccaaatacgagagcctcaaggacaaagcaccagaagcgattaattacgagcaaatcaagaaggatctcgccgaagaactgacatttgacatcgactacaaaacaagcgaagtgaatcaaagagtattctctctggacgaagtattcgaaatcgcgaacttcaacaactacctcaaccaatccggaatcactaaatttaacacaatcatcggcggtaaattcgtcaacggggaaaacacaaaacgcaaaggcatcaatgaatacatcaacctctacagccagcaaatcaacgacaaaactctcaaaaagtacaaaatgtcggtgttattcaaacaaatactatccgatacggaatccaaatccttcgtaatcgataaactcgaggacgatagcgacgtcgtcaccacaatgcaatcgttctacgaacaaatcgctgccttcaaaacagtggaagagaaatccatcaaggaaaccctttccttactctttgacgacctgaaagcacagaaacttgacctctcaaagatatatttcaaaaatgacaaaagcctgactgatctctctcagcaggtatttgacgactactcggtcatcggtaccgccgtcttagagtacatcacacaacaaatagcacccaaaaacctcgacaacccatccaaaaaggaacaagaactaattgccaagaaaacagaaaaagcgaaatacctaagcctagagacgatcaaactggcgctcgaagagttcaacaaacaccgcgacattgacaagcaatgccgcttcgaagaaatcctcgctaacttcgccgccatacccatgatcttcgatgaaatagcgcaaaataaggacaacctcgcccaaataagcatcaaataccagaaccaaggcaagaaagatctcttacaagccagcgcagaggatgacgtgaaagcaataaaagacctgctggaccagacaaacaaccttctccacaaactgaaaatctttcacatctcccagtcagaagacaaagcaaacatactggacaaagacgaacacttctacctggtttttgaggaatgctacttcgaactagcaaacatcgtccccctctataacaagatccgaaactacatcacccagaaaccgtatagcgacgagaaattcaagctcaattttgagaactccacgctggcaaacggttgggacaagaacaaagagcctgacaacaccgccatactctttatcaaggacgacaaatactacctcggggtaatgaacaagaaaaacaataaaatcttcgatgacaaagccatcaaagaaaacaaaggggaaggttacaagaaaatcgtctacaaactactcccaggcgccaacaaaatgctacccaaagtcttctttagcgcaaagtcgatcaagttctataacccatccgaagatatactgcgaatacgaaatcactcgacgcacacgaaaaacggcagcccgcaaaaaggctacgagaaattcgagtttaacatagaggactgccggaaattcatcgatttctacaagcagtccatatcaaagcacccagaatggaaagacttcgggtttcgtttcagcgacacacaacgatataacagcattgacgaattttaccgcgaagtagaaaaccaaggatacaaactgacctttgagaacataagcgagagctacattgacagcgtagtaaaccaaggcaaactctacctctttcaaatctacaacaaggacttttccgcctactccaaaggacgcccgaacctccacaccctttactggaaagcactattcgacgaacgcaacctccaggacgtcgtctataaactgaatggcgaagccgaactgttctacagaaaacaatcgataccaaagaaaataacacacccagccaaagaggccatagcgaacaaaaacaaagacaaccccaagaaagaaagcgtattcgagtatgacctcattaaagacaagcgctttacggaggacaagttctttttccactgccccatcacgatcaactttaagtccagcggcgccaataagttcaacgacgagattaatctgctactcaaggaaaaagccaacgacgtgcacatcctaagtatagaccgaggagaaagacacctggcatactacacactcgtggacgggaagggcaacatcatcaaacaagacacctttaacataatcggaaatgatcggatgaaaaccaactatcacgacaagctagcagcgatcgagaaagaccgggactccgcccgcaaagactggaagaaaataaacaacatcaaagagatgaaggagggatacctatcgcaagtagtacacgaaatcgccaagctcgtcattgaatacaacgcaattgtggtattcgaggacctcaacttcggatttaagaggggtcgcttcaaagtagaaaaacaagtctatcaaaaacttgaaaagatgctcatcgaaaaactgaactatctcgttttcaaggacaacgagttcgataaaaccggcggcgtgctccgggcctaccaattaaccgccccattcgaaacgttcaaaaagatggggaaacaaaccggcataatatattacgtcccagccgggttcacatccaaaatctgcccggtcaccggattcgtaaaccaactatatcccaagtatgaatcagtcagcaagagccaagaatttttctctaagtttgacaaaatctgctataatctcgacaagggatacttcgaatttagcttcgactacaagaacttcggcgacaaagcggccaagggcaagtggaccatagccagcttcggttcccgcctcatcaattttcgcaactccgacaagaatcacaattgggacacaagagaagtctaccccaccaaagaactcgagaagctgctaaaggactacagcattgaatacgggcacggcgaatgcataaaagcagccatctgcggggagagcgacaagaaattcttcgccaaactcaccagcgtactgaacacaatactgcaaatgcgcaactccaaaacaggcaccgaactcgactacctgatcagccccgtggccgatgtcaacggcaactttttcgactcgagacaagcgcccaaaaacatgccacaagacgccgacgccaacggcgcataccacatcgggctcaaaggtctgatgctactaggccgtataaagaacaaccaggaggggaagaaactgaacctagtaataaagaacgaggaatatttcgagttcgtccaaaacaggaataacaagaggcccgccgccacgaaaaaggcaggccaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 7178 - RNA, 51 nt, synthetic construct
  misc_feature 1..51: note = NLS2 variant
  source 1..51: mol_type = other RNA
atggcgcccaaaaaaaaacgcaaagtcggaatccacggcgtgcccgcggcc

SEQ ID NO: 7179 - RNA, 48 nt, synthetic construct
  misc_feature 1..48: note = NLS4 variant
  source 1..48: mol_type = other RNA
aaaaggccggcggcaacaaaaaaggcagggcaggcgaaaaaaaaaaag

SEQ ID NO: 7180 - RNA, 4107 nt, synthetic construct
  misc_feature 1..4107: note = Cas9 variant
  source 1..4107: mol_type = other RNA
atggacaagaagtactcaatcggccttgacatcgggaccaactccgtgggctgggccgtcatcaccgatgaatacaaggtgcccagcaagaagttcaaggtgctggggaatacggaccgccactccatcaagaagaatctgataggcgcccttctgttcgactctggggagactgcggaagccacgagactgaaacgcaccgcgcggcgccgctacacgcggcgcaagaaccgcatctgctacctgcaagagatcttctccaacgagatggcaaaggtcgacgactctttcttccatcggctcgaggagtccttcctggtggaagaagacaagaagcacgagcgccacccgatcttcggcaacatagtggacgaggtcgcataccacgaaaagtaccccaccatctaccacctcagaaagaagctcgtggacagcacagacaaggcggacctgcgcctgatctacctcgccctggcccacatgatcaagttccggggccacttcctgatcgagggggacctcaatcccgataactccgacgtggacaagctgttcatccagctggtccagacctacaatcagctgttcgaggagaaccccatcaacgcctcgggcgttgacgcgaaagccatcctgtctgcccgtctgagcaagtcccggcgcctcgaaaacctgatcgcccagttgcccggggagaagaagaacggtctattcgggaaccttatcgccctgagcctcggcctgacgcccaacttcaagtccaacttcgatttggcggaggacgccaagctccagctgagcaaggacacctacgacgacgacctggacaacctcctagcccagatcggagaccagtacgcagacctgtttctcgcggcaaagaatctgtcagacgccatcctgctaagcgacatcttgcgggtgaacaccgagataaccaaggccccgctgtccgcatcgatgatcaagcgctacgatgagcatcaccaggatctcacgctgctgaaggccctcgtccggcagcagctccccgagaagtacaaggaaatcttcttcgaccagtcaaagaacgggtacgcgggctacatagacggaggcgcctcccaggaagagttctacaagttcattaagccaatcctagagaagatggacggcaccgaagaactcctggtgaaactgaaccgcgaggacctgctccggaagcagcgcaccttcgacaacggtagtatccctcaccaaatccacctcggagagctgcacgccatcctccgccggcaggaggacttctaccccttcctgaaggacaaccgcgagaagatcgagaagatcctgacctttcggatcccctactacgtggggccgctcgcccgcggcaactcccggttcgcctggatgacgcgcaagagcgaagagaccatcaccccctggaactttgaggaagtcgtggacaagggagcgtccgcccagagcttcatcgagagaatgacaaacttcgataagaacctccccaacgagaaggtgcttcccaaacactccctcctgtacgagtacttcacggtctacaacgagttaaccaaggtgaaatacgtgaccgagggaatgcgcaagccggcctttctcagcggcgagcagaagaaagcaattgtagatctgctgttcaaaaccaaccggaaggtgacagtgaagcagttgaaggaggactacttcaagaagatcgagtgcttcgactccgtcgagatcagcggggttgaggaccggttcaacgcctccctgggcacctaccacgacctgctcaagatcatcaaggacaaggacttcttagacaacgaggagaacgaagacatccttgaggacattgtcctcacccttaccctcttcgaggatcgggagatgattgaggagaggctcaagacgtacgcccacctgttcgatgacaaggtgatgaagcagctcaagcggcgccggtacaccgggtggggccgcctcagccggaagctgatcaacgggatccgcgacaagcagtccggcaagaccatactggacttcctaaagagcgacggcttcgccaaccgcaacttcatgcagctgatccacgacgactccctgacctttaaggaggacatacagaaggcccaggtgagcgggcagggcgactctctccacgagcacatcgcgaacctagctggaagccccgccataaagaagggcatcctgcagacagttaaggtggtggacgagctcgtcaaggtgatggggcgccacaagcccgagaacatcgtgatcgagatggcccgcgaaaatcagaccacccagaagggccagaaaaactcccgggagcgcatgaagcggatcgaggagggcattaaagagctagggagccagatcctcaaggagcacccagtagagaatacccagctccaaaacgagaaactgtacctgtactacctccagaatggccgcgacatgtacgtggaccaggagctagacatcaaccggctaagcgactacgacgtggaccacatagtcccgcagagtttcctcaaggacgacagcatcgacaacaaggtgctgacgcgctccgacaaaaaccgcggcaaaagcgacaacgtgccatccgaggaagtcgtgaagaagatgaagaactattggcgccagctgctcaacgccaagctgatcacccagcggaagttcgacaacttaaccaaggccgagagagggggcctcagcgagctggacaaggctgggtttatcaagcgacagttagtagagacccgccagatcaccaagcacgtcgcccaaatcctcgactcccgcatgaacacgaagtacgacgagaacgacaagctgatacgcgaggtgaaggtgatcaccctcaagagcaagctcgtttccgacttccgaaaggacttccagttctacaaggtacgcgagatcaataactaccaccacgcccatgacgcctatctgaacgccgtagtcggcaccgcgctgatcaagaagtaccccaaactcgagagcgagttcgtgtacggggactacaaggtgtacgacgtcagaaaaatgatcgccaagtccgaacaggagatcggcaaggcaaccgccaagtacttcttctatagcaacatcatgaacttcttcaagacggagatcacccttgccaacggggagatccgcaagcggcccttaatagagaccaacggcgagaccggcgagatcgtgtgggacaaggggcgcgacttcgccacggtgcggaaggtgctctctatgcctcaggtcaacatcgtgaagaagaccgaggtccagaccggcgggtttagcaaggagtcgatcctgcccaaacgcaacagcgacaagctgatagcccgcaagaaggactgggaccccaagaagtacggcggattcgactcacccaccgtagcctacagcgtgctcgtcgtggcaaaggtggaaaagggaaagagcaagaagctgaagtccgttaaagagctgctcggcatcactatcatggaacggagctccttcgagaagaacccgatcgatttcctggaggcaaaggggtacaaggaggttaagaaggacctgatcatcaagctccccaagtactcgctattcgagctagagaacggccgcaagcggatgctagcctccgcaggggagctgcagaagggcaacgagctggccctcccctcgaagtacgtaaacttcctatacctagcctcccactacgagaagctcaaggggtcacctgaggacaacgagcagaagcaactgttcgtcgagcaacacaaacactacctggacgagatcatcgagcagatctccgaatttagcaagcgcgtgatcctcgcggacgcgaacctggacaaagtgctgtccgcctacaacaaacatcgggacaagcccatccgcgagcaggccgagaatatcatccacctcttcacactgaccaacctgggcgcccccgcggccttcaagtacttcgacaccacgatcgaccggaagcgctacacctcgaccaaggaggtgctcgatgccaccctaatccatcagtccatcacgggcttgtacgagacccggatcgacctcagccagctcgggggagactga

SEQ ID NO: 7181 - RNA, 4890 nt, synthetic construct; identical to SEQ ID NO: 1381
  misc_feature 1..4890: note = Cas9 variant
  source 1..4890: mol_type = other RNA

SEQ ID NO: 7182 - RNA, 3162 nt, synthetic construct
  misc_feature 1..3162: note = Cas9 variant
  source 1..3162: mol_type = other RNA
atgaaacgcaactacatcctggggctcgacatcggaatcaccagcgtgggctacgggatcatcgactacgagacccgggatgtgatcgacgccggcgtgcgcctgttcaaggaggcaaacgtggaaaacaacgaagggcggcgcagtaagcggggcgcccgccggctgaagcgccggcgccggcaccgtatccagcgggtgaagaagctcctttttgactacaacctgctcacggaccactccgagctgtccggtatcaacccctacgaggcccgcgtgaaggggctgagccagaagctctcagaggaagagttcagcgccgccctgctgcacctcgccaagcggcgcggcgtgcacaacgtcaatgaagtggaggaggacaccgggaacgagctgtccaccaaggagcagatcagccggaactccaaggcgctggaggagaagtacgtggccgagctccagctggagcgcctgaaaaaggacggcgaagtccgggggagcataaatcgcttcaagaccagcgactatgttaaggaggccaaacagctcctcaaggtgcagaaagcctaccaccagctagaccagagcttcatcgacacatacatcgacctcctggagacccggcgcacgtactatgagggcccgggcgaggggtcccccttcggctggaaagacatcaaggagtggtacgagatgctgatggggcactgcacctacttccccgaggagctccgctccgtgaagtacgcgtacaacgcggacctgtacaacgcactgaacgaccttaacaacctggtgatcacgcgagacgagaacgagaagctggaatactacgagaagttccagatcatcgagaacgtgttcaaacaaaagaagaagcccaccctcaagcagatcgccaaggagatcctggtcaacgaagaggacatcaagggctaccgcgtgacctccaccggcaagccggagttcacgaacctgaaggtgtaccacgacatcaaggacatcaccgcccggaaggagatcatcgagaacgcagagctcttagaccagatcgccaagatactgaccatctaccagagcagcgaggacatccaggaggagctcaccaacctgaacagcgagcttacgcaggaggagatcgagcagatctccaacctcaaggggtacactggcacccacaacctgagcctgaaggccatcaacctcatcctggacgagctgtggcacaccaacgacaaccagatcgccatcttcaaccgcctcaagctggtccccaagaaggtggacctgtcacagcagaaggagatccccacgaccttggtggacgacttcatcctgtcccccgtcgtgaaacggagcttcatccagtccatcaaggttatcaacgccattatcaagaagtacgggctgcctaacgacattatcatagagctggcgcgcgagaagaacagcaaggacgcacagaagatgatcaacgagatgcagaagcggaaccgccagacgaacgagcggatcgaggagatcatccgcaccacgggcaaggagaacgccaagtacctcatcgagaagatcaagctgcacgacatgcaggaagggaagtgcctgtactcccttgaagccatccccctggaggacctgctcaataaccccttcaactacgaagttgaccacatcatcccgcggagcgtgtccttcgacaacagcttcaacaacaaagtcctggtaaagcaggaggagaactccaagaagggcaaccgcaccccgttccagtacctgagctccagcgacagcaagattagctacgagaccttcaagaagcacattcttaacctggccaagggcaaggggcggatctccaagaccaagaaggaatacctgctcgaggagcgcgacatcaaccggttcagcgtgcaaaaggatttcatcaaccgcaacttggtcgacacgcggtacgcaacgcgcggcctgatgaacctccttcggtcctacttcagggtgaacaacctcgacgtgaaggtcaaaagcatcaacgggggcttcacctccttcctccgccggaagtggaagttcaagaaggagcgcaacaaggggtataagcaccacgccgaggacgccctgatcatcgccaacgccgacttcatcttcaaggagtggaagaagctggacaaggcgaaaaaggtgatggagaaccagatgttcgaggagaagcaggccgaatccatgcccgagatcgagaccgagcaggagtacaaggaaatcttcatcacgccccaccagataaaacacattaaggacttcaaggactacaaatacagccaccgggtggacaagaagcccaaccgcgaactcataaacgacaccctatattccacccggaaagacgacaagggcaacaccctgatcgtcaacaacctcaacggcctgtacgacaaggacaacgacaagctgaagaagctcattaacaagagcccggagaagctgctgatgtaccaccacgacccccagacgtaccagaagctcaagctgatcatggagcagtacggggacgagaagaaccccctgtacaagtactacgaagagaccggcaactacctcaccaagtactccaagaaggacaacgggcccgtgatcaagaagatcaagtactatggcaacaaactgaacgcccacctggacatcacggacgactacccgaacagccgcaacaaggtggtcaagttatcccttaaaccctaccggttcgacgtgtaccttgacaacggggtgtacaagttcgtcaccgtgaagaatctcgacgtgatcaagaaggagaactactacgaagtcaacagcaagtgctacgaggaggccaagaaactgaaaaagatctccaaccaggcggagttcatcgcgagcttctacaacaacgacctgatcaagattaacggggagctttaccgcgtgatcggcgtgaacaacgacctgctgaaccggatcgaggtcaacatgatcgacatcacgtaccgcgagtaccttgagaacatgaatgacaagcgtccgccccggatcatcaagacaatcgcctccaagacccagagcatcaagaaatactccaccgacatcctggggaacctgtacgaggtaaagagcaagaagcacccccagatcatcaagaaaggctga

SEQ ID NO: 7183 - RNA, 4230 nt, synthetic construct; identical to SEQ ID NO: 1383
  misc_feature 1..4230: note = Cas9 variant
  source 1..4230: mol_type = other RNA

SEQ ID NO: 7184 - RNA, 3306 nt, synthetic construct
  misc_feature 1..3306: note = Cas9 variant
  source 1..3306: mol_type = other RNA
atgtggtacgccagtctcatgagcgcccaccatcttcgcgtcggcatcgacgtcggcacccactccgtcggcctggcaaccctgcgagtcgacgaccacggcacacctatagagctcctaagcgcgctcagccacatacatgacagtggggtcggaaaagaaggcaagaaagaccacgatacccgcaaaaagctatcaggcatagcaaggcgggcccgcaggctcctgcaccaccgacgcacccaactacaacaactagacgaagtactacgcgatctgggcttccccataccaacacccggtgagttcctggacctcaacgagcaaaccgacccatacagagtctggcgagtaagagcccgactcgtcgaagaaaaattacccgaggaacttcgaggccccgcaatcagcatggccgttcgacacatcgcacgacacagaggatggcgaaacccctacagtaaggtcgagtcacttttaagcccggccgaagaaagccccttcatgaaggcgctgcgcgagcgcatcctagcaaccacgggggaagtcctcgatgacggaataacacctggccaagcaatggcccaagtcgcactcacacataatatatccatgcgaggtccagaaggcatactgggtaaactacaccaaagcgacaacgccaacgaaatccggaaaatttgcgcgcgacaaggcgtgtccccagacgtatgtaaacaactactgcgagcagttttcaaagcagacagccccagggggtccgcagtctcaagagtagccccagaccccctcccaggtcaagggagcttccgacgggcaccaaaatgcgacccagagttccaaagattccggataataagcatagtcgcaaacctgcgcatcagcgaaaccaaaggcgaaaacagaccactcaccgcagacgaacgacggcacgtcgtaactttccttaccgaagactcccaggcggacctcacctgggtcgacgtagccgaaaaactaggagtacaccgacgggacctacgcggcacagcagtacacacagacgacggcgagagaagcgccgccagaccacccatcgatgccacagaccgaataatgcgacaaaccaaaataagcagccttaaaacctggtgggaagaagctgatagcgaacagcgaggcgccatgataagatacctatacgaagaccccacagactcggaatgcgccgagataatagccgaactacccgaagaggaccaagccaaacttgacagcctacacctacccgcagggagggcggcgtatagcagagaatcactaacggcgctttccgaccacatgctagcaacaaccgacgacctgcacgaggcacgtaagcgcctattcggcgtcgacgacagctgggcaccgccagctgaagccataaacgcaccagtcggaaacccatccgtagaccggacactgaaaatcgtcgggcgctaccttagcgcggttgaatcaatgtggggaacacccgaggtaatccacgtagagcacgtcagagacggtttcaccagcgaaagaatggccgacgaacgcgacaaggcaaacagacgaagatataacgacaaccaggaagccatgaaaaagatccaacgagactacgggaaagaagggtacatcagccgaggtgacatagtgagactcgacgcactggaactccaaggctgcgcctgtctctactgcggaacaacaataggataccatacctgccagctagaccacatcgtaccccaagcaggacccggaagcaacaaccgaaggggaaacctggtcgcagtatgcgaacggtgcaaccgcagtaagagcaacacaccgttcgcagtatgggcgcaaaaatgcggaatcccccacgtaggggtcaaggaggcaatcggacgagtcaggggatggcgcaagcaaaccccgaacacgagcagcgaggacctcacacggctcaagaaagaagtcatagcccgactaaggcgcacgcaagaggatcccgaaatagacgagaggtcgatggaaagcgtggcctggatggcaaacgaactccaccaccgcatagcagcggcctaccctgagactacggtaatggtctacagaggttcaataactgcagcagcgagaaaagctgcaggcatagacagccgaattaacctaatcggcgaaaaaggacgaaaagaccgaatagacaggcgtcaccacgcagtggacgcctctgtggtagcactcatggaggcgtcagtggcaaaaacactagcagaacgcagcagtttgagaggggagcagcgactgacaggaaaagaacaaacatggaaacaatacaccgggagcactgtcggagcccgagagcacttcgaaatgtggcgcggccacatgcttcacctaacagaactgttcaacgaacgcctcgcggaggacaaagtatacgtcacgcaaaacatacgcctccgactgagcgatggaaacgcccacacagtcaacccgtcaaagctcgtctcacaccgcctcggagatgggctgaccgtgcaacagatagaccgcgcatgcacccccgcactatggtgtgcgcttaccagagagaaagacttcgacgagaaaaacggcctacccgcacgagaagaccgagcgatccgcgtacacggacacgagataaaatcctcggactacatacaagtcttctcgaagcgcaaaaagacagactcggacagggacgaaacgcccttcggagccatcgcggtcagaggaggcttcgtagaaatcggaccgtcaatacaccacgcccggatatacagagtggaagggaaaaagccagtttacgcaatgctcagagtattcacccacgacctcctctcccaaaggcacggagacctcttcagcgcagtcataccaccacaatctatctcaatgcgctgcgcagaaccaaaactaagaaaagccataactacggggaacgccacatacctcggatgggtagtagtaggcgacgaactagagataaacgtcgattcgtttacaaaatacgcgataggacggtttctagaagatttccccaacacaacccgatggagaatttgcggctatgacacgaactcgaaactcacactaaaaccaattgtgctagcggcagaaggactggaaaatccctccagcgccgtaaacgagatagtcgaactaaaaggatggcgcgtagccattaacgtcctaaccaaagtacatccaacggtagtacgccgagacgccctgggcagaccaagatacagctcccgctccaacctcccaacaagctggacaatagaatga

SEQ ID NO: 7185 - RNA, 4167 nt, synthetic construct; identical to SEQ ID NO: 1385
  misc_feature 1..4167: note = Cas9 variant
  source 1..4167: mol_type = other RNA

SEQ ID NO: 7186 - RNA, 3249 nt, synthetic construct
  misc_feature 1..3249: note = Cas9 variant
  source 1..3249: mol_type = other RNA
atggcagctttcaaaccgaactcaatcaactacatactaggactagacataggcatcgcgagcgtcggctgggccatggtcgaaattgacgaagaggaaaacccaatccgacttatagacctcggggtaagagtattcgaaagagccgaagtcccaaaaacgggggacagcctagcgatggccaggagactagcacgctccgtgcgtcgactcacaagacgccgagcccacagactgctcagaacacgcagactcctgaaacgggagggagtccttcaagcagccaactttgacgaaaacgggctcattaaatcactcccgaacaccccatggcagctgcgagcggcagcactcgaccgaaaactcaccccactcgaatggagcgcagtcctccttcacctgatcaaacaccgaggttatctatcccagcgcaaaaacgaaggggaaacagcagacaaagaactcggcgcactcctcaaaggagtggccgggaacgcccacgcactacaaacaggcgacttcagaaccccagccgagctcgcactaaacaaattcgaaaaagaatccggacacatacgtaaccaacgatcagactacagccacacattctccaggaaagacctacaggccgaactcatactcctattcgaaaaacaaaaagagttcggcaacccacatgtatccggaggactaaaggaaggaatcgaaacgctactaatgacccagaggccagccctaagcggtgacgctgtccagaaaatgctcggtcattgtacattcgagccggctgaaccgaaagcagcaaagaacacttatacagcagaacgattcatctggctcacaaaactcaataacctgagaatcctcgagcaaggatccgaacggccactaacagacacagaacgcgcaacgctcatggacgaaccataccgaaagtcaaaacttacctacgcacaagctcgcaaactcctgggactagaagacactgcattctttaaaggcctccggtacggaaaagacaacgcggaagcatccacactcatggagatgaaagcctaccacgccatatcgagagccctagaaaaggaggggctaaaggacaagaaaagccccctcaacctcagcccggagcttcaagacgaaataggcacagccttctccctcttcaagacggacgaagacatcacaggcagacttaaagacagaatccagccggagatactggaagccttactcaaacacatcagcttcgacaaattcgtacaaatctctctcaaagccctccgcagaatagtacctctcatggaacaagggaaacgctatgacgaagcctgtgccgaaatctacggcgaccactacgggaagaaaaatacggaagagaaaatctacctaccgcccatccccgcagacgaaatccgaaacccagtcgtcctccgcgcattgtcacaggcacgaaaggtaatcaacggcgtcgtacgtcgctacggctccccggctcgaatccacatagaaacagcccgtgaagtagggaaatcattcaaagacagaaaagaaatagaaaagcgccaagaagaaaaccggaaagaccgagaaaaggcagcagcaaagttccgagaatacttcccaaacttcgtaggcgaaccaaagagcaaagacatactaaaacttaggttatacgagcagcaacacggcaagtgcctatactcaggaaaggaaataaacctaggccgcctcaatgaaaaaggctacgtcgaaatcgaccacgccctgccgttctccaggacctgggacgacagcttcaacaacaaagttctcgtcctcggcagcgaaaatcaaaacaaaggaaaccagacaccttacgaatacttcaacggaaaggacaacagccgagagtggcaagagttcaaggcaagagtggaaacatcccgattcccccgctcgaaaaagcagcgcatcctactacaaaaattcgacgaggacggcttcaaagaacgcaacttaaacgacacccgctacgtaaaccgcttcctatgccaattcgtagccgaccgcatgcgactcacgggtaagggaaagaagcgagtcttcgcatccaacggacaaataacaaacctcttacgcgggttctggggactaaggaaagtacgcgccgaaaacgatcgccaccatgccctcgacgccgtggtcgtagcatgctccactgtcgcaatgcaacaaaagataacccgcttcgtacgctacaaggagatgaacgccttcgacggcaagacaattgacaaggaaactggcgaagtgcttcaccagaaaacacacttcccccaaccctgggagttcttcgcacaagaagtaatgatacgcgtcttcggtaaaccggacgggaaaccggagttcgaagaagctgacacattggaaaaactccgaaccctactggcggaaaagctcagcagccggcccgaagccgtacacgaatacgtcaccccactcttcgtgtctcgggcgcccaacaggaagatgtccggacaaggacacatggaaacggtaaaatcagcgaaacgactggacgaaggcgtatccgtcctacgcgtgcccctcacacaactcaaactcaaggacctagagaaaatggtaaaccgcgaacgagaacccaagctatacgaggccctaaaagcccgcctagaagcacacaaggacgaccctgcaaaggctttcgctgaacccttctacaaatacgacaaagccggcaaccgaacccaacaagtaaaagcagtacgagtcgaacaagtgcagaaaacaggcgtatgggtccgaaaccataacggaatcgctgacaacgctacgatggtccgcgtcgatgtcttcgagaaaggcgacaaatactacctagtcccaatatactcgtggcaagtagcaaaaggaatcctgccagaccgagccgtcgtacaaggcaaagacgaagaggattggcaactgatcgacgatagcttcaacttcaagttcagcctccaccccaacgacctcgtggaggtgataaccaagaaagctcgtatgttcggctacttcgcgtcctgccaccggggaacgggcaacatcaacatacgcattcacgacttagaccacaaaataggtaaaaacgggatactcgaaggtatcggagtgaaaacagcactcagcttccaaaaataccaaatagacgaactaggcaaggagataagaccatgcaggctcaaaaagagaccacccgtgagatga

SEQ ID NO: 7187 - RNA, 4005 nt, synthetic construct
  misc_feature 1..4005: note = Cas9 variant
  source 1..4005: mol_type = other RNA
atgaagaagccctacaccatcgggctggacatcgggacaaacagcgtgggctgggccgtcctcacggaccagtacgacctggtgaagcgcaagatgaagatcgccggggactccgagaagaagcagatcaagaaaaacttctggggcgtgcggctgttcgacgaggggcagacggcggccgaccgccggatggcccgcaccgctcggaggcggatcgagcgccggcgcaaccggatcagctacctccagggcatcttcgccgaggagatgtccaagaccgacgcgaacttcttctgccgcctgagcgactccttctacgtcgacaacgagaaacggaacagccgccacccgttcttcgccacaatcgaggaggaggtggagtaccacaagaactaccccaccatctaccacctccgggaggagctagtgaactccagcgagaaggccgacctgcgcctagtctacctcgccctggcgcacatcatcaagtaccggggcaacttcctgatcgagggggccctcgacacccagaacacctccgtggacggcatctacaagcagttcatccagacgtataaccaggtgttcgccagcgggatcgaagacggctccctgaagaagctggaggacaacaaggacgtcgccaagatcctcgttgagaaggtgacccgcaaggagaagctggagcggatcctgaagctctaccccggggagaagtccgccggcatgttcgcgcagttcatcagcctgatcgtcggcagcaaggggaacttccagaagcccttcgacctgatcgagaagtccgacatcgagtgcgccaaggacagctacgaggaggacctcgagagcctgctggcattgatcggcgacgagtacgccgagctgttcgtggccgctaagaacgcctacagcgccgttgtattgtccagcatcatcaccgtggccgagaccgagacgaacgccaagctcagcgcgtccatgatcgaacgcttcgacacacacgaggaggacctgggggagttaaaggccttcatcaagctccacctcccgaagcactacgaggagatcttcagcaacaccgagaaacacggctacgccggctacatcgacgggaagaccaagcaggccgacttctacaagtacatgaagatgacgctggagaacatcgagggcgccgactacttcatcgcgaagatcgagaaggagaacttcctgcggaagcagcgcaccttcgacaacggggccattccccaccagctgcacctggaggagctcgaggccatcctgcaccagcaggccaagtactaccccttcctgaaggagaactacgacaagatcaagtctctcgtgaccttccgcatcccctacttcgtcggcccgctggcgaacgggcagtcggagttcgcctggctgacccggaaggccgacggcgagatccgcccctggaacatcgaggagaaggtggacttcggcaagtccgccgtggacttcatcgagaagatgacgaacaaggacacctacctcccgaaggagaacgtcctgcccaagcacagcctgtgctaccagaagtacctcgtgtacaacgagctgaccaaggtgcggtacatcaacgaccaggggaagacctcctacttcagcggccaggagaaggagcagatcttcaacgacctgttcaagcagaagagaaaggtcaagaagaaggacctcgagctgttcctgcggaacatgtcccacgtggagagcccgacgatcgaggggctggaggactccttcaactcttcctacagcacctaccacgacctcctgaaggtcggcattaagcaggagatcctggacaaccccgtaaacaccgaaatgctcgaaaacatcgtgaagatcttgaccgtcttcgaggacaagcgcatgatcaaggagcagctgcagcaattctccgacgtcctcgacggggtggtcctgaagaagctggagcggcgccactacacgggctggggccggctcagcgccaagctgctgatggggatccgcgacaagcagtcccacctcaccatcctggactacctgatgaacgacgacggcctcaaccggaacctgatgcagctgatcaacgacagcaacctctccttcaagagcatcatcgagaaggagcaggtcaccaccgcggacaaggacatccagagcatcgtggccgacctggccgggtcccccgccatcaaaaagggcatcttgcagagcctcaaaatcgtggacgagctggtatccgtgatggggtacccgccccagacgatcgtcgtggagatggcccgcgagaaccagaccaccggaaagggcaagaacaacagccggcctcgctacaagtccctggagaaggcgatcaaggagttcgggagccaaatcctcaaggagcaccccaccgacaaccaggagctgaggaacaaccgcctgtacctctactacctgcagaacggcaaggacatgtacacggggcaggacctggacatccacaacctctccaactacgacatcgaccacatcgtgccccagtcttttataaccgacaactccatcgacaacctggtcctgaccagctccgccggcaaccgggagaagggcgacgacgtgccgcccctcgagatcgtgcgcaagcggaaagtcttctgggagaagctgtaccaggggaacctgatgagcaagcgcaagttcgactacctcaccaaggccgagcgcggcgggctgaccgaggcagacaaggcccggttcatccaccgccagctggtggagacgcggcagatcaccaagaacgtggcgaacatcctccaccagcgctttaactacgagaaggacgaccacggcaacaccatgaaacaagtccggatcgtgaccttaaagtccgccctggtgtctcagttccgcaagcagttccagctctataaggtccgggacgtgaacgactaccaccacgcacacgacgcctacctcaacggggtggtcgcgaacacgctgctcaaggtgtacccccagctggaacccgagtttgtgtacggcgactaccaccagttcgactggttcaaggccaacaaggccaccgccaagaagcagttctacacgaacatcatgctgttcttcgcccagaaggaccgcatcatcgacgagaacggcgagatcctctgggacaagaagtacctggacacagtcaagaaggttatgtcctaccggcagatgaatatcgtgaagaagacggagatccagaagggggagttcagcaaggcgaccatcaagccgaagggcaactcctccaagctgatcccccgcaagaccaactgggaccccatgaagtacgggggcctcgacagccccaacatggcctacgccgtcgtgatcgagtacgccaaggggaagaacaagctggtgttcgagaagaagatcatccgggtcaccatcatggagcgcaaggccttcgagaaggacgagaaggcgttcctcgaggagcagggctaccggcagccgaaggtgctcgccaagctgcccaaatacacgttatacgagtgcgaggagggccgccggcgcatgctcgcctctgctaacgaggcccagaaggggaaccagcaggtcctgcccaaccacctggtgaccctcctgcaccacgcggccaactgcgaggtgagcgacggcaagtccctggactacatcgagagcaaccgcgagatgttcgccgagctcctggcccacgtgtccgagttcgcgaagcgttacaccctggccgaggccaacctcaacaagatcaaccagctgttcgagcagaacaaggagggagacatcaaagcaatcgcccagagcttcgtagacctaatggcgttcaacgccatgggcgccccggcctcctttaagttcttcgagaccacgatcgagcggaagcgctacaacaacctcaaggagctgctgaacagcaccatcatctaccagtccatcaccgggttgtacgagagccggaagcgcttggacgactga

SEQ ID NO: 7188 - RNA, 4038 nt, synthetic construct; identical to SEQ ID NO: 1388
  misc_feature 1..4038: note = Cas9 variant
  source 1..4038: mol_type = other RNA

SEQ ID NO: 7189 - RNA, 3171 nt, synthetic construct
  misc_feature 1..3171: note = Cas9 variant
  source 1..3171: mol_type = other RNA
atgcagaccacaaacctgagctacatactcggcctagacctaggaattgcctcagttggctgggccgtagtagaaataaacgaaaacgaagaccccatcggcctaatcgacgtcggagtgcgaatattcgaacgggcagaagtgcccaaaaccggagaaagtctcgcactatcacgacggctcgcccgatcgacgcgccgcctaattcgcagacgtgcacaccgcctgctcctagcaaaacggttcctcaaacgcgagggaatcctctcgacaatcgacctagaaaaaggcctccccaaccaagcctgggagctacgggtagccggtctcgagagacgcctaagcgcgatagagtggggagccgtcctactccacctcataaaacatcgaggataccttagtaaacgtaaaaacgagtcacagacaaacaacaaagagctcggtgcactactctcaggcgtagcccagaaccaccaactcctacaaagcgatgattaccgaacaccagcagaactcgcactcaaaaagttcgcgaaagaggaaggacacatccgcaaccaaagaggagcgtacacgcacactttcaaccgactcgaccttctagcagagcttaacctgttgttcgcacaacaacatcagttcggcaacccacattgcaaagaacacattcagcaatacatgaccgaactcctcatgtggcaaaagcccgccctctcaggagaagccatcctcaaaatgctgggcaaatgcacccatgagaaaaacgagttcaaagcagcaaagcacacctacagcgccgaacgtttcgtctggctcactaaactcaacaacttacgaatactcgaggacggggctgagcgggctctcaacgaagaggaacggcagctcctgatcaaccacccatacgaaaaatccaaactcacatacgcccaagtaagaaaactactcggactatctgaacaagcaatcttcaaacacctcagatactccaaagaaaacgccgaatccgctacattcatggaactcaaggcctggcacgccatacgcaaagccctagaaaaccagggattaaaagacacatggcaagatctcgccaagaaaccagatctcctagacgaaatcggaacagccttttcactttacaaaaccgacgaagacatccaacaatacctcaccaacaaagtccctaacagcgtgatcaatgccctcctagtctctcttaatttcgacaaattcatagaactgagcctgaaaagtcttcgaaaaatactgcccctaatggaacaaggcaaacgctatgaccaagcatgccgagagatatacggccaccactacggcgaggccaaccagaaaacatcacaactactccccgcaatccccgcacaagaaatcaggaaccccgtagtcctaagaacactcagccaagcaaggaaagtaataaacgcaatcattcgacaatacgggagccccgcgagagtccacatagaaaccggccgtgaactcggaaagagcttcaaagagcgccgcgaaattcagaaacaacaggaagacaacagaacgaaacgagagtcagcagtacaaaagttcaaggaactcttcagcgacttctcaagtgaacccaaatccaaggacatactgaaattcaggctatacgagcaacaacacgggaaatgtctatactccggtaaagaaataaacattcaccgcctgaatgaaaaagggtacgtcgagatagaccacgcactccccttctcacgcacctgggacgacagcttcaacaataaggtcctagtcctagcgtcggaaaatcaaaacaaaggtaaccagacaccatacgaatggctccaaggcaaaatcaactccgaacgctggaaaaacttcgtcgccctggtactaggatcccaatgctcagcagcgaagaaacaacgcctcctaacacaagtaatagacgacaacaagtttatagaccgaaacctaaacgacacccgctatatcgcgaggtttttatcaaactacatacaagaaaacctccttcttgtcggcaaaaacaagaaaaacgtcttcaccccaaacggacagatcacagccctcctccgcagccggtggggcctaataaaggcacgcgaaaacaataataggcaccacgctctcgatgccatcgtcgtagcctgcgcaacaccctcaatgcaacagaaaatcacccgcttcataagattcaaggaagtgcacccctacaaaatagaaaaccgctacgaaatggtagaccaagaaagcggcgagatcatcagtccccacttccccgaaccctgggcctactttagacaagaggtcaacattcgcgtcttcgacaaccacccagacacagtgctgaaagaaatgctcccggaccggccgcaagcaaaccatcaatttgtccaaccgctattcgtctcccgagctccgacgcgcaaaatgagcggccaaggacacatggaaaccatcaagtccgcaaaacgcctagcagaaggcataagcgtactacgcatccctctaacccagctaaagcccaacctcctagaaaacatggtaaacaaagaacgcgaacccgcactgtacgcgggcctgaaagcacgtctagccgagttcaaccaagatcccgccaaggcattcgccacaccattctacaaacaaggcggacaacaagttaaagccattagagtcgaacaagtccaaaagagtggagtactcgtccgcgaaaataacggggtcgcagacaacgcgagcatcgttcggacggacgtattcatcaagaacaacaagttcttccttgttcccatctacacctggcaggtagccaaaggcatcctccccaacaaagccatagtggcccacaaaaacgaggacgaatgggaagaaatggacgaaggcgcaaaattcaaattctccctgttccccaacgacctcgtggaactcaagacgaagaaagaatacttcttcggctactacatcggactcgatcgggccacagggaacataagcctgaaagagcatgacggagaaataagtaaaggcaaagacggcgtgtacagggtcggcgtcaaactggcgctaagtttcgaaaaataccaagttgacgagctaggtaaaaatcgccagatctgccggccacaacaacggcaacccgtcagatga

SEQ ID NO: 7190 - RNA, 3249 nt, synthetic construct
  misc_feature 1..3249: note = Cas9 variant
  source 1..3249: mol_type = other RNA
atggccgccttcaagccgaatccgatcaactatatcctgggcctcgacattggcatcgccagcgtaggctgggccatggtcgaaatagacgaagacgaaaacccgatctgcctaatcgacctgggcgtacgcgtatttgaacgcgccgaagtcccaaaaacgggcgactcactcgccatggctcggcgactagcccgcagcgtacgccgactgacacgacgacgagcccaccgacttctacgagcccgacgcctcctaaaacgcgaaggcgtactacaagcagcagatttcgatgaaaacgggctcataaaaagcctgcccaacactccctggcaactacgagccgccgccctcgatcgcaagctgacacccctcgaatggagcgcagtcctcctacacctcataaaacaccgaggctacctctcccagcgtaaaaacgaaggagagaccgctgacaaggaactaggcgcgctcctcaaaggagtagcggataacgcacacgcactccaaacaggcgacttccgcacacccgccgaactagcactgaacaaattcgaaaaagaatcaggccacatccggaaccaaagaggggactacagccacaccttctcaagaaaggacctacaagccgaactcatcctcctattcgaaaagcaaaaggagttcggcaacccacacgtttccggcggattaaaagaaggcatcgaaacgctcctaatgacgcagcggcccgccctctcaggtgacgccgtacaaaagatgctagggcactgcaccttcgagccagccgaaccaaaggccgcgaaaaacacctatacagcagaacgcttcatctggctcacaaagctcaacaacctccgaatcctcgaacaggggtccgagcggcccctgacagacacagaacgcgccaccctcatggacgaaccctaccgcaaatcgaaacttacctacgcccaagcgcgtaagctgctcggcctcgaagacaccgcattcttcaaagggctcagatacggcaaagacaacgcagaagcgtccaccctaatggaaatgaaggcataccacgcaatcagtcgagcactagagaaagagggcctcaaagacaagaaaagtcccttaaacttaagcccagagctgcaggacgaaataggcaccgccttctccctatttaaaacagacgaagacatcaccggacggctgaaggacaggatacaaccagagatcctcgaagcactactcaagcacatatccttcgacaaattcgtgcaaatctcactcaaagcactcagacgaatagtaccactcatggagcagggcaagcgatacgacgaggcatgcgcagagatctatggcgaccactacggcaagaaaaacaccgaggagaaaatatacctgcccccaataccggccgacgaaatcaggaaccccgttgtcctacgggcactgtcacaggccagaaaagttataaacggcgttgtccgacgctatggaagcccagcacggatacacatcgaaaccgcaagagaagtcggcaagagcttcaaagaccgcaaagaaatagaaaaacgccaggaagagaacagaaaggaccgagagaaagcagccgccaaattcagagaatacttccccaacttcgttggcgaacccaagagcaaagacatcctaaaacttcgactgtacgagcaacaacacggaaaatgcctctacagcgggaaagaaattaacctcggacgcctaaacgaaaaaggatacgtagaaattgaccacgcgctaccgttctcaagaacttgggacgacagcttcaataacaaagtgctagtcttaggctctgaaaaccaaaacaagggcaaccaaacgccgtacgaatacttcaacggaaaagacaactcccgggaatggcaagagttcaaagcccgcgtcgaaacatcccgcttcccgagatccaagaaacaaagaatactcctccagaaattcgacgaagacggattcaaagaacgaaaccttaacgataccagatacgtcaaccgcttcctctgccaattcgtagcagaccgcatgcgcctcacaggaaaaggcaaaaagcgagttttcgccagtaacggacaaatcaccaacttgctacgaggtttctggggactgcgaaaagttagagccgaaaacgatcgccatcacgccctggacgcggttgtggtcgcatgctcgaccgtcgccatgcaacagaagatcacccgcttcgtccgatacaaagaaatgaacgcattcgacggcaaaacgatcgacaaagaaacaggggaagtcctccaccagaaaactcacttcccccaaccatgggaatttttcgcccaagaagtaatgatccgagtcttcggcaaaccagatgggaagcccgagttcgaagaagcagatacgccggaaaaactaaggaccctcctggccgagaaactaagcagccgccccgaagccgttcatgagtacgtaacccccttgttcgtaagcagagcacccaaccgcaaaatgagcggacaagggcacatggaaaccgtcaaaagtgccaagcgactcgacgaaggtgttagcgtcctaagagtccccctgacccaacttaagctcaaagatctggagaaaatggttaacagagaacgcgaacccaagctatatgaagccctgaaggcacgactcgaagcccacaaggacgacccggctaaagccttcgccgaaccattctacaaatacgacaaagccggaaaccgaacgcaacaagtcaaagcggtacgtgtggaacaagtccagaaaacaggggtgtgggtccgcaatcacaacggaatcgcagacaacgccaccatggtcagggttgacgtgttcgaaaagggggacaaatactacttagtaccaatatacagttggcaagtggccaaaggaatcctacctgacagagcagtagtacaagggaaggacgaagaagattggcaacttatagacgactcgttcaacttcaaattcagcctccaccccaacgacctagtagaagtgatcaccaagaaagcccggatgtttggatacttcgcaagctgccacagaggaacaggaaacatcaatatcagaatacacgacctagaccacaaaatcggcaaaaacggaatcctcgaaggaatcggagtcaaaacagcgcttagcttccagaaataccagattgacgaactcggaaaagaaatccgcccgtgccgcctgaaaaagcgtcctcccgtacgatga

SEQ ID NO: 7191 - RNA, 3255 nt, synthetic construct
  misc_feature 1..3255: note = Cas9 variant
  source 1..3255: mol_type = other RNA
atgaaataccacgttgggatagacgtaggaacattcagcgtcggcctagcagccatagaagtagacgacgccggtatgccaatcaaaaccctcagtctggtatcacacattcacgactcaggcctagatcccgacgagataaaatcagcagtgaccaggttagcaagctccggaatcgccagaagaacacgacgcctctaccgccgcaaacgaagaaggctccaacaactcgacaaattcatacaaagacaaggctggccggtgatcgaattggaagattactcagacccactctacccctggaaggtaagagcagaactcgcagcatcctacatagcagacgaaaaagaacgcggcgaaaaactctccgtggccctcaggcacatagcacggcaccgggggtggagaaacccctacgccaaagtgagcagcctatacttgccagacggcccaagcgatgcattcaaagcgatacgggaagagataaaaagagcatcagggcagcccgtccccgaaacagccacagtaggccaaatggtcaccctctgcgagctcggaacgcttaaactaagaggcgaaggtggagtcctaagcgcccgactacagcaatcggactacgcccgcgaaatacaagaaatctgccgaatgcaggagatcggacaagaactttacaggaaaataatagacgtcgtcttcgcagccgaatcgccaaaaggctcagcatccagcagggtaggcaaagacccgctccagccgggcaagaacagagcacttaaagcatccgacgcattccagaggtatagaatagccgcacttataggaaaccttcgagtcagagtcgatggtgagaaaagaatattgagcgtcgaagagaaaaacctcgtctttgaccacctcgtaaatctaacaccaaagaaggaaccagaatgggtaacaatagccgaaatattaggaattgaccggggccagcttatcggcacggccacaatgaccgacgacggcgaacgcgccggtgctagaccaccgacccacgacacaaaccggtcgatagtgaacagcaggatcgcacccctagtagattggtggaaaaccgcatccgcactcgagcaacacgcgatggtaaaagcactttccaacgcagaagtggacgacttcgacagccccgaaggcgccaaagtacaagcattcttcgcggaccttgacgacgacgtccacgcgaaactcgactccttacacctacccgtaggccgggccgcatactctgaagacaccctggtccgactgacacgacgaatgctttcagacggcgtggacctttataccgcccgactacaggagttcgggatagaaccgtcctggactccccctacaccccgaataggagaaccagtaggaaatccagcagtagaccgagtcctaaagaccgtatcaagatggctcgaatccgcaacaaagacatggggagcaccagaaagagtcatcatagaacacgtcagagaaggcttcgtaaccgagaaaagagcccgagaaatggacggggacatgcgaaggagagcagccagaaacgccaaactattccaagaaatgcaagaaaaacttaacgtccaaggtaaaccaagccgagcggatttatggcgctaccaatccgtccaaagacagaactgccagtgcgcatactgcggatctcccatcaccttcagcaacagcgaaatggaccacatcgtcccgagggccggccaaggaagcacaaacacccgcgaaaacttagtcgcagtatgtcaccgctgcaaccagtccaaaggtaacacccccttcgcaatctgggccaaaaacacgtccatagagggagtatcagtgaaagaggccgtagaacggaccaggcactgggttaccgacaccggcatgcgaagcaccgatttcaagaaattcacaaaggccgtcgtcgagagattccaaagagcaacgatggacgaagagatagacgcccgatcgatggaatcggtggcctggatggccaacgagctaagaagtcgggtggcccaacacttcgcctctcacggaaccacggtccgagtctaccgcgggagcctaaccgccgaggcgcggagggccagtggaatatcaggaaagctgaagttcttcgacggcgtgggcaagagccggctggacaggagacatcacgcaatagacgcagcagtgatagccttcactagcgactatgtcgcagaaactctagcagtccgcagcaaccttaaacaaagccaagcacaccggcaagaagcaccccagtggcgggagttcacaggaaaagacgccgaacaccgcgccgcctggagggtttggtgtcagaaaatggaaaaattaagtgcactcctaaccgaagacctccgggacgaccgggttgtagtcatgtccaatgtacgactccgcctaggcaacggcagcgcacacaaggaaacaataggcaaactaagcaaagtcaaactctcttcgcagctatccgtcagcgacatagataaagcctcatccgaagcattatggtgcgccctcacacgcgaacccggattcgacccaaaggagggtctaccagccaatccagaaaggcacatacgagtgaacggaacccacgtatacgccggagacaacatcgggctattccccgttagcgccggaagcatagcactacggggcggttacgcagaactcggaagctcgtttcaccacgcgcgagtttacaaaatcacatcaggcaaaaagccagcattcgcgatgctgcgagtatacaccatcgacctactaccctacaggaaccaggacctttttagtgtggagctaaaaccacaaaccatgtccatgagacaagcggaaaagaaactacgagacgccctagcaacaggaaacgcagaatacctagggtggcttgtagtagacgacgagctagtagtagacaccagcaaaatagcaacagaccaagtaaaagcagtagaagcagagctcggaaccatacgacggtggagagtcgacggattcttcagcccctcaaaactacggctacgaccactccaaatgagcaaggaaggaataaagaaagaaagcgcgccggagctctcaaaaatcatcgaccggcccggctggctaccagcggtaaacaaactcttcagcgacggcaatgtcacggtagtcaggagagacagcctaggacgcgtaagactcgaaagcacagcacacctcccagtcacctggaaagtacagtga

SEQ ID NO: 7192 - RNA, 2955 nt, synthetic construct
  misc_feature 1..2955: note = Cas9 variant
  source 1..2955: mol_type = other RNA
atggcccgcatcctcgccttcgacatcggcataagctccatcgggtgggcgttcagcgagaacgacgagctcaaagactgcggcgtgcggatcttcaccaaggtcgagaaccccaagaccggtgagtccctggccctgccgcgccggctcgcccgcagcgcccggaagcgcctggcccggcgcaaggcgcggctgaaccacctcaagcacctgatcgccaacgagttcaagctgaactacgaggactaccagagcttcgacgagagcctcgccaaggcttacaagggctcactgatctctccctacgagctgagattccgggcgctcaatgagttactgtccaagcaggacttcgcccgcgtgatcctccacatcgccaagcggcgcgggtacgacgacatcaagaacagcgacgacaaagagaagggcgccatcctgaaggcgatcaaacaaaacgaggagaagctggctaactaccagtccgtgggcgagtacctctacaaggagtacttccagaagttcaaggagaacagcaaggagttcacgaacgtccggaacaagaaggagtcctacgagcgctgcatcgcccagagcttcctgaaggacgagctgaagctcatattcaagaagcagcgggagttcgggttctccttctcaaagaagttcgaggaggaggtgctgtccgtggccttctataagcgcgccctgaaggacttcagccacctcgtcggcaactgctccttcttcaccgacgagaagcgggcccccaagaacagccccctggcgttcatgttcgtggccctgacgcgtatcatcaacctcctgaataacctgaagaacaccgagggaatcctctacacgaaggacgacctgaacgccctgctcaacgaggtgctgaagaacggcaccctgacctacaagcagacgaagaagctcctggggttgagcgacgactatgagttcaagggggagaagggcacgtacttcatcgagttcaagaagtacaaggagttcatcaaggccctcggggagcacaacctctcccaggacgacctgaacgagatcgccaaggacatcaccctcatcaaggacgagatcaagctgaagaaggcgctggccaagtacgacctcaaccagaaccagatcgacagcctgtccaagctggagttcaaggaccacctcaacatcagcttcaaggccctgaagctggtcaccccgctgatgttagagggcaagaagtacgacgaggcctgcaacgagctgaacctgaaggtggccatcaacgaggacaagaaggacttcctccccgcgttcaacgagacctactacaaggacgaggtgacgaaccccgtcgtgctgcgggccatcaaggagtacaggaaggtgctgaacgccctcctgaagaagtacggcaaggtccacaagatcaacatcgagctggcccgcgaggtgggcaagaaccactcccagcgggcgaagatcgagaaggagcagaacgagaactacaaggccaaaaaggacgccgagctcgagtgtgagaagctgggcctgaagatcaacagcaagaacatcctcaagctgcgcctgttcaaggagcagaaggagttctgcgcctactccggggagaagataaagatcagcgacctccaggacgagaagatgctggagatcgaccatatctacccctactcccggagcttcgacgactcctacatgaacaaagtgctggtcttcaccaagcagaaccaggaaaagctcaaccagacacctttcgaagccttcggcaacgacagcgcgaagtggcagaagatcgaggtgctggccaagaacctgcccaccaagaagcagaagcgcatcctcgacaagaactacaaggacaaggagcagaagaacttcaaagaccggaacctgaacgacacgcgctacatcgcccggctggtgctcaactacaccaaggactacctggacttcttacccctctccgacgacgagaacaccaaactaaacgacacccagaaggggagcaaggtccatgtggaggccaagtccggcatgctgacgagcgccctccgccacacctgggggttctccgcgaaggaccggaacaaccacctccaccacgcgatcgacgccgtgatcatcgcctacgccaacaacagcatcgtcaaggcgttctccgacttcaagaaggagcaggagagcaacagcgcggagctgtacgccaagaagatctccgagctggactacaagaacaagcgcaagttcttcgagcccttcagcggcttccggcagaaggtgctggacaagatcgacgagatcttcgtgtccaagccggagcgcaagaagcccagcggcgccctgcacgaggagaccttccggaaggaggaggagttctaccagtcctacgggggcaaggagggggtactcaaggcgctggagctgggcaagatccgcaaggtgaacgggaagatcgtcaagaacggcgacatgttccgggtggacatcttcaagcacaagaagaccaacaagttctacgccgtgcctatctacacaatggacttcgccctcaaggtcctgcccaacaaggccgtggcccgctcgaagaagggcgagatcaaggactggatcctgatggacgagaactacgagttctgcttctccctctacaaggacagcctgatcctgatccagaccaaggacatgcaggagccggaatttgtgtactacaacgcgttcacctcaagcacagtttccctcatcgtgagcaagcacgacaacaagttcgagacgctgtccaagaaccagaagatcctgttcaagaacgccaacgagaaggaggtgatcgccaagagcatcgggatccagaacctcaaggtcttcgagaagtacatcgtgtccgccctgggcgaggtgaccaaggccgagttccggcagcgcgaggacttcaagaagtga

SEQ ID NO: 7193 - RNA, 3366 nt, synthetic construct
  misc_feature 1..3366: note = Cas9 variant
  source 1..3366: mol_type = other RNA
atgagcgacttggtcctcggcttagacatcgggatcggctccgtcggggtgggcatcctgaacaaggtgaccggggagatcatccacaagaacagccgcatcttcccggccgcccaggcggagaacaacctcgtccggcgcaccaaccggcagggccgccggctggcccgccggaagaagcaccgccgggtgcgcctgaaccgcctcttcgaggagtccggcctgatcacggacttcaccaagattagcatcaacctgaacccgtaccagctccgggtgaaggggctgaccgacgagctgtccaacgaggagctgttcatcgccctgaagaacatggtcaagcatcggggcatcagctacctggacgacgccagcgacgacgggaacagctccgtgggcgactacgcccagattgtgaaggagaacagcaagcagctcgagaccaagacgcccgggcagatccagctggaacgctaccagacctacggccagcttcggggcgacttcaccgtcgagaaggacgggaagaagcaccgcctcatcaacgtgttccccacctccgcgtaccggagcgaggccctgcgcatcctgcagacgcagcaggagttcaacccccagatcaccgacgagttcatcaaccgctacctcgagatcctgaccggcaagcgcaagtactatcacgggccgggcaacgagaagtcccggaccgactacggccgctaccgcacgtcaggggagaccctggacaacatcttcggcatcctcatcgggaagtgcaccttctaccccgacgagttccgggcggccaaggcgtcctacaccgcccaggagttcaacctgctgaacgacctcaacaacctgacggtgcccaccgagaccaagaagctgagcaaggagcagaagaaccagatcatcaactacgtcaagaacgagaaggctatgggccccgccaagctgttcaagtacatcgccaagctcctgtcctgcgacgtcgcggacatcaaggggtaccgcatcgacaagagcggcaaggccgagatccacaccttcgaggcctaccggaagatgaagacgctcgagaccctggacatcgagcagatggaccgcgagaccctggacaagctcgcctacgtgctgaccctaaacacggagcgggaaggcatacaggaggccctcgagcacgagttcgcggacgggtccttcagtcagaagcaagtcgacgagctggtgcagttccgcaaggccaatagctccatcttcggcaaggggtggcacaacttcagcgtgaagctgatgatggagctcatcccggagctgtacgagacctccgaggagcagatgaccatcctgacacggctcggcaagcagaagacgaccagctccagcaacaagaccaagtacatcgacgagaagctgctcaccgaggagatctacaaccccgtcgtggccaagtccgtgcgccaggccatcaagatcgtcaacgccgcgataaaggagtacggggacttcgacaacatcgtgatcgagatggcccgagagaccaacgaggacgacgaaaagaaagcaatccagaagatccaaaaggccaacaaggacgagaaggacgccgcgatgctcaaggccgccaatcaatacaacggcaaggccgagctgccccacagcgtgttccacggccacaagcagctggcgaccaagatccgcctgtggcaccagcagggggagcggtgcctctacaccggcaagaccatctccatccacgacctgatcaacaacagcaaccagttcgaggtcgaccacatcctgcccctctccatcacgttcgacgacagccttgccaacaaggtgctggtctacgccaccgccaaccaggagaaggggcagcgcaccccgtaccaggccctcgactcgatggacgacgcatggagcttccgggagctgaaggccttcgtgcgcgagtccaagaccctgagcaataagaagaaggaatacctcctgacggaggaagacatttccaagttcgacgtgcgcaagaagttcatcgagcgcaatctggtcgacacgcggtacgcctctcgcgtggtgctcaacgccctgcaggagcacttccgggcccacaagatcgacaccaaggtttccgtggtgcgcggccagttcaccagtcagctgcgccggcactgggggatcgagaagacccgcgacacgtaccaccaccacgcggtcgatgcccttatcatcgcagccagctcccagctgaacctgtggaagaagcagaagaacaccctcgtgagctactccgaggaccagctgctagacatcgagaccggcgagctcatcagcgacgacgagtacaaggagtccgtgttcaaggccccctaccagcactttgtcgacaccctcaagagcaaggagttcgaggactccatcctgttcagctaccaggtggactccaagttcaaccggaagatcagcgacgcgacgatctacgccacccgccaggccaaggtgggcaaggacaaggccgacgagacctatgtcctcgggaaaatcaaggacatctacactcaggacggctacgatgcgttcatgaagatctacaagaaggacaagtccaagttcctgatgtaccgccacgacccccagacgttcgagaaggtgatcgagcccatcctggagaactacccgaacaagcagatcaacgagaaggggaaggaagtgccctgcaaccccttcctcaagtataaggaggagcacggctacatccgcaagtacagcaagaagggcaacgggcccgagatcaagtccctgaagtactacgacagcaagctgggcaaccacatcgacatcaccccgaaagactccaacaacaaggtagtgctccagagcgtgtccccctggcgggcggacgtctacttcaacaaaaccaccgggaagtacgagatcctgggcctgaagtacgccgacctccagttcgagaaggggacgggcacctacaagatcagtcaggagaagtacaacgacatcaagaagaaggagggcgtggacagcgactccgagttcaaattcaccctgtacaagaacgacctgctcctggtgaaagacactgagacgaaggagcagcaactgttccgcttcctcagccggaccatgcctaagcagaagcactacgtcgagctgaagccctacgacaagcagaagttcgagggcggggaggccctgatcaaggtgctcgggaacgtggccaactccggccagtgcaagaaggggctgggcaagagcaacatctccatctacaaggtccgcacagacgtgctgggcaaccagcacatcatcaagaacgagggggacaagccgaaactcgacttctga

SEQ ID NO: 7194 - RNA, 2556 nt, synthetic construct
  misc_feature 1..2556: note = Cas9 variant
  source 1..2556: mol_type = other RNA
atgaccaacggcaagattctggggctcgacatcggcgtggccagcgtcggggtgggcatcatcgaggccaagaccgggaaggtgatccacgcaaactcccgcctgttcagcgccgccaacgccgagaacaacgccgagcggcggggcttccggggcgcgcgccggctgacgcgccggaagaagcaccgcgtcaagcgggtgagagacctcttcgagaagtacgacatcctgaccgacttccggaacctgaacctcaacccctacgagctgcgcgtgaaggggctgaccgagcagctcaccaatgaggagctgttcgccgccctgcggacgatcgccaagcgccggggcatctcctacctagacgacgcagaggacgacagcaccgggtccagcgactacgccaagtccatcgacgagaaccgccggctgctcaagagcatgacccccggccagatccaactggagcgcctggagaagtacgggcagctgcggggcaacttcacagtctacgacgagaacggcgaggcccaccgcctaatcaacgtgttctccacgagcgactacaagaacgaggcccggaagatcctggagacccagtccaactacaacaagcagatcaccgacgagtttatcgaagactacatcgagatcctgacccagaagcgcaagtactaccacgggcccggcaacgaaaagtcccgcacggattacgggcggttccgcaccgacggcaccaccctcgagaacatttttggcatcctgatcgggaagtgcagcttctaccccgaggagtaccgggccagcaaggcgtcctacacggcccaggagttcaacttcctgaacgacctcaataacctgaaggtgcccaccgagaccggcaagctgagcaccgagcagaaggagtacctcgtcaacttcgccaagaactccaagacgctgggggccagcaagctgctcaaggagatcgccaagctggtggacggcgacgtgaaggacatctccgggtaccgcgaggacagcaagggcaagccggacctgcacaccttcgagccctaccggaagttgaaattcaacctgaccaccgtcgacatcgacaacctgagccgcgacatcctcgacaagctggcggacatcttaacgctcaacaccgagcgggaggggatcgaggacgccattaaccagaacctgcccgagcagttcaccaaggagcagatctccgaaatcgttcagatccgcaagagccagtccagcgccttcaacaaggggtggcactccttcagcgccaagctgatgaacgagcttatccccgagctgtacgccacctccgaggaacagatgacgatcctgacccggctcgagaagttcaaggcgactaagaagtccagcaagaacaccaagacgatcgacgagaaggagataaccgacgaaatctacaacccggtggtcgccaagagcgtgcgccagaccatcaagatcatcaacgccgccgtgaagaagtacggcgacttcgacaagatcgtcatcgagatgccccgggacaagaacgccgacgacgagaagaagttcatcgacaagaagaacaaggagaacaagaaggagaaggacgactccctgaagcgcgcggcatacctgtacaacgggaccgacaagctccccgacgacgtgttccacggcaacaagcaattggccacgaagatccggctttggtaccagcagggggagagatgcctgtacagcggcaagcccatcctcatccaggacctggtgcacaattccaacaacttcgagatcgaccatatcctgccgctcagcctgtccttcgacgacagcctggccaacaaggtcctcgtgtacgcgtgggccaaccaggagaaggagcagaagaccccctaccaggtgatagactccatggacgccgcctggagcttccgggaaatgaaggattatgtcctgaagcagaagggcatcgggaagaagaagcgcgagtacctgctcaccaccgagaacatcgacaaaatcgaggtgaaaaagaagttcatcgaacggaacctggtcgacacccgctacgcctcccgggtggtgctcaacagcctccagacggcgctgaaagagctgggaaaggataccaaagtcagcgtggtgcgcgggcagttcacctcccagctccgccggaagtggaagatcgataagagccgcgagacctaccaccaccacgccgtcgacgccctgatcatcgccgcctccagccagctgaagctctggcagaagcacgagaacctgatgttcgagaactacggcgagaaccaggtggtgaacaaggagacgggcgagatcctgtccatcagcgacgacgaatacaaggagtccgtattccagccgccctaccagggcttcgtgaacaccatcagctccaaggcgttcgaggacgaaatcctcttcagctaccaggtggattccaagttcaaccggaaggtcagcgacgccaccatctactccacccgcaaggccaagctgggcaaggacaagaaggaggagacgtacgtgctggggaagtga

SEQ ID NO: 7195 - RNA, 2598 nt, synthetic construct
  misc_feature 1..2598: note = Cas9 variant
  source 1..2598: mol_type = other RNA
atgagacacaagataggcctggacataggaatcacctccgtggggtgggctgtaatcaaccttgacatcccacgcattgaagacctcggagtccgcatattcgaccgcgcggaaaacccccaaaccggcgaatctctcgcactacccagacgcctggcccgaagcgcgcgacgacgcctaagacgccgaaaacacagactagaacgtatccgacgactcctaatcagagaaggcatactgacaaaagaggaactcgataaactgtttgaggaaaagcatgagatcgatgtctggcaattacgagttgaggcactcgaccgcaaacttaacaacgacgaactagcaagggtcctactacacctagccaaacgaagaggctttaaatcaaaccgcaagagcgaacgtaacaacaaagagaactcaacaatgctcaaacacatagaagaaaaccgagcactgctgagcggatacagaaccgtcgccgagatgatcgtcaaagatccgaaatttgccttccacaaacgcaataaaggcgaaaattacactaacaccatcgcacgagacgacctagaacgcgagatcaaacttatcttcacaaaacagcgggaatacgggaacatcgtctgcaccgagaccttcgaaaacgaatatatcatgatatgggcatcgcagcgaccctttgcctccaagaacgacatagagaagaaagtagggttctgcacattcgaaccgaaagagaaaagggcaccaaaagccacatacacattccaatctttcgtcgcatgggagcacataaacaaactccgcctggtttaccccaccggcacccgcggcctcaccgacgaagaacgacgactcctctacaaacaagcctttcataaaaacaaaataacttaccacgatatccggacactcctgcacctacccgacgacacctacttcaaaggaatcgtatacgaccgcggggcaccactcaaacaatccgaaactatccgcttcctggaacttgacgcttaccaccagattcgcaaggccgttgacaaggtctacggtaagggcaaaagctccagcttcctcccgatcgacttcgacacatttgggtacgcattgacactcttcaaagatgacgctgacatccggtcctacttacgcaacgaatacgaacagaatggcaaacgtatgcccaatctcgccaacaaggtctatgacaacgagccgatcgaggaactacttaacctatccttcacaaaattcggccatctttctctaaaagcactgcgcaacatcctcccatatatggagcaaggcgaagtgtactcggtcgcgtgcgaaagggctggatacacattcaccggacccaaaaagaaacagaaaaccctcctactaccaaatattccccctatcgccaacccagtagtcatgcgcgcactaacacaagcacgcaaagttgttaacgcgatcataaagaaatacggaagccctgtcagcatccacatcgaactcgcacgcgatctttcacaaacgttcgacgaacgccgaaaaacaaaacgcgaacaagacgaaaaccgcaagaaaaacgaaaccgcgatccgacaactcatggaatacggcctaaccatcaaccccaccggccacgacatcgtcaaattcaaactctggtcagaacaaaacggcagatgcgcatactccctacaacccatcgaaatcgaacgcctcctagaaccaggatacgtagaagtagaccacgttattccctacagcagatccctagatgacagctacacaaacaaagtcctcgtcctcaccaaagaaaaccgtgaaaaaggaaacagaatacccgcagaatacctcggcgtcggcaccgaacgctggcaacaattcaaaacatttgtcctcaccaacaaacaattctccaaaaagaaaagagaccgactcctacgcctccactacgacgaaaacgaagaagccgaatggaaaaacagaaacctaaacgacacacgctacatctcacgcttcttcgccaacttcatccgcgaacacctaaaatttgcagaatcagacgacaaacaaaaagtatacacagtcaacggccgcgtgaccgcacacctccgatccagatgggatttcaacaaaaaccgcgaagaatcagacctccaccacgcagtagacgccgccatcgtcgcatgtacgagcccgagcgacatcgcgcgagtgacagccttctaccaacgccgagaacaatgcaaggaatccgcgaagaaagcagaaccacacttcccccaaccctggccccacttcgccgacgaactacgcgcacgcctaagcaaaaatcccaaagagtcaatcaaagctcttaacctaggaaactatgacgaccagaaactagaaagcctgcaacccgtatttgtatcacgcatgccgaagcgaagcgtaaccggtgcagcacaccaagaaaccctccggcgctacatcggaatagacgaacgttcgggcaagatccaaaccgtcgtaaaaacaaaactaagcgaaataaaactcgacgaaaccggacacttcccgatgtacggaaaagagtccgacccacccgcctcagcgtga

SEQ ID NO: 7196 - RNA, 2886 nt, synthetic construct
  misc_feature 1..2886: note = Cas9 variant
  source 1..2886: mol_type = other RNA
atggcccgcatcctggccttcgacatcggcattagctccatcgggtgggcgttcagcgagaacgacgagctcaaggattgcggcgtgcgtatcttcaccaaggctgagaaccccaagaccggggagtccctggccttaccgcgacggctcgcccgcagcgcccggaagcgcctggcgagacgcaaggccaggctgaaccacctcaagcaccttatcgccaatgagttcaaattgaactacgaggactaccagtccttcgacgagagcctcgccaaggcgtacaaaggatccctgatcagcccctacgagctgcgattccgggccctcaacgagctgttgtccaagcaggacttcgcccgcgtcatcttgcacatcgccaagcgtcgcgggtacgatgacatcaagaacaacggcgacgaggaaaagggcaagatcctgaaggccatcaagcaaaacgaggagaaactggtgaactaccagagcgtgggggagtacttgtataaggagtactttcagaagttcaaggagaacagcaaggagttcattaacgtccggaacaagaaggagagctacgagcgctgcatcacgcaatccttcctgaagtacgagctgaagctcatcttccagaagcagcgggagttcgggttcagcttctccaagaagttcgaggaggaggtgctgagcgtggcgttctacaagcgcgcgctgaaggacttctcccacctcgtggggaactgctcgttcttctccgacgagaaaagagcccccaagaacagcccgctggccttcatgttcgtggccctgacccgcatcatcaacctcctgaacaacctgaagaacaccgaaggtatcctctataccaaggacgacctaaacgcgctgctcaacgaagtgctgaagaacgggacgctgacctacaagcagacaaagaaactcctgggcctgagcgacgactacgagttcaagggcgagaaggggacttactttatcgagttcaagaagtacaaggagttcatcaaggccctcggcgagcacaacctgtcccaggacgacctgaacgagatcgcaaaggacattacgctcatcaaggacgagataaagctgaagaaggccctggccaagtacgacctcaaccagaatcagattgacagcctgtccaagctggagtttaaggaccacctcaatatcgggttcaaggcgctgaagctgataacgccgctgatgctcgagggcaagaaatacgacgaggcctgcaacgagctgaacctgaaggtcgccatcaacgaggataagaaggacttcctacccgccttcaatgagacctactacaaggacgaggtgaccaaccccgtggtcctacgggctatcaaggagtatcgcaaggtgctgaacgcgctcctgaagaagtacggcaaggtgcacaagatcaacatcgaactggcccgcgaagtcgggaagaaccacagccagcgggccaagatcgagaaggaacagaacgagaattacaaggccaagaaggacgcggagctcgaatgcgagaagctgggcctgaagattaactccaagaacatcctcaagctgcgcctgttcaaggagcagaaggagttctgcgcctacagcggagagaagatcaagctctccgacctgcaggacgagaagatgctggagatcgatcacatctacccctacagccggtccttcgacgacagctacatgaacaaggtgctcgtgttcacgaaacagaaccaggagaaactgaacaagaccccgttcgaggccttcggcaacgacaatgtcaaatggcaaaagatcgaggtgctggccaaaaacctccccgagaagaagcagaagcgcatcctggacaagaactacaaggacaaggaacagaaagacttcaaggaccggaacctgaacgacacccgctacatagcccggctcgtgttaaactacacgaaggactacctggacttcctccccctgtccgacgacgagaacacgaagctgaagggcagcaaggtccacgtggaggcgaagtccggcatgctcaccagcgccctgcgccacacctggggcttctccacaaaggatcggaacaaccatctccaccacgccatcgacgccgccatcatcgcgtacgccaacaacagcatcgtgaaggacttctccgacttcaagaaggagcaggagagtaactccgccgaactgtacgccaagaagatcagcgagctggactacaagaacaagcgcaagttctttgagcccttctccgggttccggcaaaaagtcctggacaagatcgacgagatcttcgtgtccaagccggagcgcaagaagcccagcggcgctctacacgaggagacgtttcggaaggaagaagagttctaccaatcctacggaggcaaggagggggtgctgaaggcgctggagctcggcaagattcgcaaggtgaatggcaagatcgtgaagaacggggacatgttccgcgtcgacatcttcaagcacaagaagacgaacaagttctacgccgtgcccatctacaccatggacttcgccctgaaggtgctgccaaacaaggccgtcgcgcgcagcaagaagggcgaaatcaaggactggatcttgatggacgagaactacgagttctgcttctctctgtacaaggacagcctgatcctaatccagaccaaagacatgcaggagccggagctggtgtatttcaacgccttcacgtccagcaccgtatcactgatcgtcagcaagcacgacaacaagttcgagacgctctccaagaacctgaaggtgttcgagaagtacatcgtcagcgccctgggggaggtcaccaaggccgagttccggcagcgcgaggacttcaagaatgagctccggtga

SEQ ID NO: 7197 - RNA, 2955 nt, synthetic construct; identical to SEQ ID NO: 1397
  misc_feature 1..2955: note = Cas9 variant
  source 1..2955: mol_type = other RNA

SEQ ID NO: 7198 - RNA, 2955 nt, synthetic construct
  misc_feature 1..2955: note = Cas9 variant
  source 1..2955: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccctggcgctgccgcgccggctcgcccgcagcgcccggaagcgcctggcgcggcgcaaggcccggctgaaccgcctcaagcacctgatcgccaatgagttcaagctgaactacgaggactaccagtctttcgacgagagcttagccaaggcgtacaagggctccctgatcagcccctacgagctgcggttccgcgccctcaacgagctgctgtccaagcaggacttcgcccgggtcatcctccacatcgcaaagcgccgggggtacgacgacatcaagaacagcgacgacaaggagaagggcgccatcctgaaggcgatcaagcagaacgaggagaagctggccaactaccagtcggtgggcgagtacctctacaaggagtacttccaaaagttcaaggagaacagcaaggagttcacgaacgtgcgtaacaagaaggagtcatatgagcggtgcatcgcccagagcttcttaaaggacgagctgaagctcatcttcaagaagcagcgcgagttcggtttctccttcagcaagaagttcgaggaggaggtcctgtccgtggcgttctacaagcgggccctgaaggacttcagccacctcgtgggaaactgctccttcttcaccgacgagaaacgcgctcccaagaacagccccctggccttcatgttcgtcgccctgacccggattatcaacctcctgaacaacctgaagaacaccgaggggatcctctacacgaaggacgacctgaacgccctgctcaatgagttcctgaagaacggcaccctgacctacaagcagaccaagaagctcctggggttaagcgacgactacgagttcaagggcgagaagggcacgtacttcatcgagttcaagaagtacaaagagttcatcaaagctctcggggagcacaacctgtcccaggacgacctgaacgagatcgcgaaggacatcaccttaatcaaggacgagatcaagctgaagaaggccctggccaagtacgacctcaaccaaaaccagatcgactcgctgtccaagctggagttcaaggaccacctcaacatcagcttcaaggccctgaagctgatcaccccgctgatgctcgaaggcaagaagtacgacgaggcctgcaatgagctgaacctgaaggtggcgatcaacgaggacaagaaggacttcctccccgccttcaacgaaacctactacaaggacgaggtgacgaaccccgtcgtgctgcgcgccatcaaggagtaccgcaaggtgctgaacgccctcctgaagaagtacgggaaggtccacaagatcaacatcgagctggcgagagaggtgggcaagaactactcccagcgcgccaagatcgagaaggagcagaacgagaactacaaggccaaaaaggacgccgagctcgagtgcgagaagttaggccttaagatcaacagcaagaacatcctcaagctgcggctgttcaaggagcaaaaggagttctgcgcctactccggggagaagataaaaatcagcgatctccaggacgaaaagatgctggagatcgaccacatctacccctactcccgcagtttcgacgactcctacatgaacaaggtgctggtcttcaccaagcagaaccaggagaagctcaaccagaccccgttcgaggcgttcggcaacgacagcgccaagtggcagaagatcgaagtgctcgccaagaacctgcccaccaagaagcagaagcggatcctcgataagaactacaaggacaaggagcagaaagacttcaaggaccgcaacctgaacgacacgcggtacatcgcccgcctggtgctcaactacaccaaggactacctggacttcctgcccctctccgacgacgagaacaccaagctaaacgacacccacaaggggagcaaagtccacgtggaggccaagtccggcatgctgacgagcgcgctccggcacacctgggggttctccaccaaggaccgcaacaatcacctccggcacgccatcgatgccgtgatcatcgcctacgccaacaacagcatcgtcaaggcgttctccgacttcaagaaggagcaagagagcaacagcgccgagctgtacgccaagaagatctcagagctggactacaagaacaagcgcaagttcttcgagcccttcagcggcttccggcagaaggtgctggacaagatcgacgagatcttcgtgtccaagccggagcgcaagaagccgagcggcgccctgcatgaggaaaccttccggaaggaggaggagttctaccagtcctacgggggcaaggagggggtcctcaaggcgctggagctgggcaagatccgcaaggtgaacgggaagatcgtcaagaacggcgacatgttccgggtggacatcttcaagcacaagaagacaaacaagttctacgccgtgcccatctacaccatggacttcgccttaaaggtcctgcccaacaaggccgtggcccgcagcaagaagggcgaaatcaaggactggatcctgatggacgagaactacgagttctgcttctccctctacaaggacagcctgatcctgatccagaccaaggatatgcaggagccggagttcgtgtactacaacgcgttcacctccagcacggtctccctcatcgttagcaagcacgacaacaagttcgagaccctgtccaagaaccagaagatcctgttcaagaacgccaacgagaaggaggtgatcgccaagagcatcgggatccagaacctcaaggtcttcgagaaatacatcgtgtccgccctgggcgaggtgaccaaggccgagttccggcagcgtgaggactttaagaagtga

SEQ ID NO: 7199 - RNA, 2955 nt, synthetic construct; identical to SEQ ID NO: 1399
  misc_feature 1..2955: note = Cas9 variant
  source 1..2955: mol_type = other RNA

SEQ ID NO: 7200 - RNA, 2955 nt, synthetic construct
  misc_feature 1..2955: note = Cas9 variant
  source 1..2955: mol_type = other RNA
atggcccgcatcctggccttcgacatcggcatcagctccatcgggtgggcgttcagcgagaacgacgagctcaaggactgcggcgtgcggatcttcaccaaggccgagaaccccaagaccggggagtccttagccctgccgcgccggctcgcccgcagcgcccggaagcgcctggcgcggcgcaaggcccggctgaaccacctcaagcacctgatcgccaacgagttcaagctgaactacgaggactaccaatccttcgacgagagcctcgcaaaagcgtacaagggatccctgattagcccatacgagctgcgcttccgggccctcaacgagctgctgtccaaacaggacttcgcccgcgtcatcctccacatcgccaagcggcgcgggtacgacgacatcaagaatagcgacgacaaggagaagggcgccattctgaaggcgatcaagcagaacgaggagaagctggccaactaccagtccgtaggcgagtacctctacaaggagtacttccagaagttcaaggaaaacagcaaggagttcacgaacgtgcggaacaagaaggagtcctacgagcgctgcatcgcccagagcttcctaaaggacgagctgaagctcatcttcaagaagcagcgggagttcgggttttccttcagcaagaagttcgaggaggaggtcctgtccgtggccttctacaagcgcgccctgaaggacttcagccacctcgttggcaactgctccttcttcaccgacgagaagcgggcgcccaagaacagccccctggccttcatgttcgtcgccctgacgcgcatcatcaacctcttaaacaacctgaaaaacaccgaggggatcctctacacgaaggacgacctgaacgccctgctcaacgaggtgctgaagaacggcaccctgacctacaagcagaccaagaagctcctggggctgagcgacgattacgagttcaagggcgagaagggcacgtacttcatcgagttcaagaagtacaaggagttcatcaaggccctcggggatcactccctgagccaggacgacttaaacgagatcgcgaaggacatcaccctcattaaggacgagatcaaactgaagaaagcccttgccaagtacgacctcaaccagaaccagatcgactccctgagcaaactggagttcaaggaccacctcaacatctccttcaaggccctgaagctgatcaccccgctgatgctcgaaggcaagaagtacgacgaggcctgcaacgagctgaacctgaaggtggcgatcaacgaggacaagaaggacttcctccccgccttcaacgagacctactacaaggacgaggtcacgaaccccgtggtgctgcgggccatcaaggagtaccgcaaaatcttaaacgccctcctcaagaagtacgggaaggtccacaagatcaacatcgagctggcgcgcgaggtgggcaagaaccatagccagcgggccaagatcgagaaggagcagaacgagaactacaaggccaagaaggacgccgagatcgagtgcgagaagctcggcctgaagatcaactcgaagaatatcctgaagctccgcctgtttaaggagcagaaggagttctgcgcctacagcggggagaagatcaagctgtccgacctccaggacgagaagatgctggagatcgaccacatctacccctacagccggtccttcgacgacagctacatgaacaaggtgctggtctttaccaagcagaaccaggagaaactcaacaagaccccgttcgaggcgttcggcaacgactccaccaagtggcagaagatcgaagtgctggccaagaacctgcccgagaagaagcagaagcgcatcctcgacaagaactacaaggacaaggagcagaaagactttaaggaccggaacctgaacgacacgcgctacatcgcccggctggtgctcaactacaccaaggactacctggacttcctgcccctcagcgacgacgagaacacaaagctgaacgacacccagaaggggtccaaggtccacgtcgaggccaagagcggcatgctgacgtccgccctcaggcacacctggggtttcagcgcgaaggacagaaataaccacctccaccacgccatcgacgccgccatcatcgcgtacgcgaacaactccatcgtgaaggcctttagcgacttcaagaaggagcaggagagcaactccgtcgagctgtacgccaagaagatcagcgagctggactacaagaacaagcgcaagttcttcgagcccttctcaggtttccggcagaaggtgctggacaagatcgacgagatcttcgtgagcaagccggagcgcaagaagccgtccggcgccctgcacgaggagaccttccggaaggaggaggagttctaccaaagctacgggggcaaggagggggtcctcaaggcgctggagctgggcaagattcgcaaggtgaatgggaagatcgtcaagaacggcgacatgttccgggtggacatcttcaagcacaagaagacaaacaagttctacgccgtgcccatctacacgatggacttcgccttgaaagtcctgcccaacaaggccgtggcccgctccaagaaaggcgagatcaaggactggatcctgatggacgagaactacgagttctgcttcagcctctacaaggactccctgatcctgatccagaccaaggacatgcaggagccggagctcgtgtacttcaacgcgttcaccagctccaccgtcagcctgatcgtgtccaagcacgacaacaagttcgagacgctgagcaagaaccagaagatcctcttcaagaacgccaacgagaaggaagtgatcgccaagtccatcgggatccagaacctgaaggtcttcgagaagtacatcgtgagcgccctgggcgaggttaccaaggccgagttccggcagcgagaggacttcaagaagtga

SEQ ID NO: 7201 - RNA, 2955 nt, synthetic construct; identical to SEQ ID NO: 1401
  misc_feature 1..2955: note = Cas9 variant
  source 1..2955: mol_type = other RNA

SEQ ID NO: 7202 - RNA, 2955 nt, synthetic construct
  misc_feature 1..2955: note = Cas9 variant
  source 1..2955: mol_type = other RNA
atggcacgcatcttggccttcgacatcggcatcagctccatcgggtgggcgttcagcgagaacgacgagctaaaggactgcggcgtgcggatcttcaccaaggccgagaaccccaagaccggggagtccctggccctgccgcgccggctcgcgcgcagcgcccggaagcgcctggcgcgccgcaaggcccggcttaaccacctcaagcacctgatcgccaacgagttcaagctgaactacgaggactaccagtccttcgacgagagcctcgccaaggcgtacaagggctccctgattagcccctacgagctgcgcttccgggccctcaatgagctgctgtccaagcaggacttcgcccgcgtcatcctccacatcgccaagcggcgcgggtacgacgacatcaagaacagcgacgacaaggagaagggcgccattctgaaggcgatcaagcaaaacgaggagaagctggccaactaccagtccgtgggcgagtacctctataaggagtacttccagaagttcaaggagaacagcaaggagttcaccaacgtgcggaacaaaaaggagtcctacgagcgctgcatcgcccagagcttcctgaaggacgagctgaagctcatcttcaagaaacagcgggagttcgggttctccttctcgaaaaagttcgaggaggaggtcctgtccgtggccttctacaagcgcgccctcaaggacttcagccacctcgtgggaaactgctccttcttcaccgacgagaagcgggcgcccaagaacagccccctggccttcatgtttgtggccctgacccgcatcatcaacctcctgaacaacctgaagaacaccgagggcattctctacacgaaggacgacctcaacgccctgctcaacgaagtgctgaaaaacggcaccctgacttacaagcagaccaagaagctcctggggctgagcgacgactacgagttcaagggcgagaagggcacgtacttcatcgagttcaagaagtacaaggagtttatcaaggccctcggggaccactccctgagccaggacgacctgaacgagatcgcgaaggacatcaccctcatcaaggacgagatcaagctgaagaaggccctggccaagtacgacctcaaccagaaccagatcgactccctgagcaagctggagttcaaggaccacctcaacatctccttcaaggccttgaagctgatcaccccgctgatgctcgagggcaagaagtacgacgaggcctgcaacgagctgaacctgaaagtggcgatcaacgaggacaagaaagacttcctccccgccttcaacgagacctactataaggacgaggtcacgaaccccgtggtgctgcgggccatcaaggaataccgcaaggttctgaacgccctcctgaagaagtacgggaaggtgcacaagatcaacatcgagctggcgcgcgaggtgggcaagaactacagccagcgggccaagatcgagaaggagcagaacgagaactacaaggccaaaaaggacgccgagctcgagtgcgagaaactgggcctgaagatcaactcaaagaacatcctcaagctgcgcctgttcaaggagcagaaggagttctgcgcttatagcggggagaagatcaaaatctccgacctccaggacgagaagatgctggagatcgaccacatctacccctacagccggtccttcgatgacttctacatgaacaaggtcctggtgttcaccaagcagaaccaggagaagctcaaccagaccccgttcgaggcgttcggcaacgatagcgccaagtggcagaagatcgaggtgctggccaagaacctgcccaccaagaagcagaagcgcatcctcgacaagaactacaaggacaaggagcagaaggacttcaaggaccggaacctgaacgacacgcgctacatcgcccggctggtcctcaactacaccaaggactacctggacttcctgcccctctccgacgacgagaacaccaagctgaacgacacccagaaggggagcaaggtgcacgtcgaggccaagtccggcatgctgacgagcgcgctccgccacacctgggggttctccgccaaggaccggaacaaccacctccaccacgccatcgacgccgtcatcatcgcctacgcgaacaacagcatcgtgaaggccttctccgacttcaagaaggagcaagaaagcaacagcgccgagctgtacgccaagaagatctccgagctggactacaagaacaagcgcaagttcttcgagcccttcagcggcttccggcagaaggtgctggacaagatcgacgagatcttcgtctccaagccggagcgcaagaagcccagcggcgctctgcacgaggaaaccttccggaaggaggaggagttctaccagtcctacgggggcaaggagggggtcctcaaggccctggagctgggcaagatccgcaaggtcaatgggaagatcgtgaagaacggcgacatgtttcgggtggacatcttcaagcacaagaagacgaacaagttctacgccgtccccatctacacgatggacttcgccctaaaggtgctgcccaacaaggccgtggcgcgcagcaagaagggcgagatcaaggactggatcctgatggacgagaactacgagttctgcttctccctctacaaggacagcctgatcctgatccagaccaaggacatgcaggagccggagttcgtctactacaacgccttcacctccagcaccgtgtccctcatcgtaagcaagcacgacaacaagttcgagacgctgtccaagaaccagaagatcctgttcaagaacgccaacgagaaggaggtcatcgcgaaaagcatcgggatccagaacctcaaggtgttcgagaagtacatcgtgtccgccctgggcgaggtcactaaggcggagttccggcagcgcgaagacttcaagaagtga

SEQ ID NO: 7203 - RNA, 2955 nt, synthetic construct; identical to SEQ ID NO: 1403
  misc_feature 1..2955: note = Cas9 variant
  source 1..2955: mol_type = other RNA

SEQ ID NO: 7204 - RNA, 2955 nt, synthetic construct
  misc_feature 1..2955: note = Cas9 variant
  source 1..2955: mol_type = other RNA
atggtgcgcatactggcgtttgacatcggcatcagctccatcgggtgggccttcagcgagaacgacgaactcaaggattgcggcgtccggatcttcactaaggtggaaaaccccaagaccggggagtccctggcgctaccgcgtcggctcgcccgcagcgcccggaagcgcctggcccggcgcaaggcccggctgaaccacctcaagcacctgatcgcgaacgagttcaagctgaactacgaagactaccagtccttcgacgaaagcctcgccaaggcctacaagggctccctgatcagcccatacgagctgcgcttccgggccctcaacgagcttctgtccaagcaagatttcgcgcgcgtcatcctccatatcgccaagcggcgcgggtacgacgacatcaagaacagcgacgacaaggagaaaggcgccatcctgaaggccatcaagcagaacgaggagaagttagccaactaccagtcagtcggcgagtacctctacaaggagtacttccagaagttcaaggagaactctaaggagttcacgaacgtgcggaacaagaaggagtcctacgagcgctgcatcgcacagagctttctgaaggacgagctgaagctcatattcaagaagcagcgggagttcgggttctccttcagcaagaagttcgaggaggaagtgctgtccgtcgccttctacaagcgcgccctgaaggacttcagccacctcgtgggcaactgcagtttcttcacggacgagaagcgggcccccaagaacagccccctggccttcatgttcgtggcgctgacccgcatcatcaacctcctgaacaacctgaagaacactgaggggatcctctacacgaaagacgacctgaacgccctgctcaacgaggtcctgaagaacggcaccctgacctacaagcagaccaagaagctacttgggctgagcgacgactacgagttcaaaggcgagaagggtacgtactttatcgagttcaagaagtacaaggagttcatcaaggccctcggggagcacaacctgtcccaggacgacttaaacgagatcgccaaggacatcaccctcatcaaggacgagatcaagctgaagaaggccctggcgaagtacgacctcaaccagaaccagatcgacagcctgtccaagctggagttcaaggaccacctcaacatcagcttcaaggccctgaagctgatcaccccactgatgctcgaaggcaagaaatacgacgaggcctgcaacgagctgaatttgaaggtggccatcaacgaggacaagaaggacttcctccccgccttcaacgagacctactacaaggacgaggtgacgaaccccgtcgtcctgcgggcgatcaaggagtaccgcaaggtgctgaacgctctcctgaagaagtacgggaaggtccacaagatcaacatcgaactggcccgcgaggtgggcaagaaccactcccagcgggccaagatcgagaaggagcaaaacgaaaactacaaggcgaagaaggacgccgagctcgagtgcgagaagctgggcctgaagatcaacagcaagaacatccttaagctgcgcctgttcaaggagcagaaggagttctgcgcctactctggggagaagatcaagatcagcgacctccaggacgagaagatgctggagatcgaccacatctacccctactcccggagcttcgacgactcctacatgaacaaggtgctggtcttcaccaagcagaaccaggagaagctcaacaagaccccgttcgaggccttcggcaacgacagcgccaagtggcagaagatcgaggtgctggcgaagaacctgcccaccaagaagcaaaagcgcatcctcgacaaaaactacaaggacaaggagcagaaggacttcaaggaccggaacctgaacgacacgcgctacatcgcccggctggtgctcaactacaccaaggactacctggacttcctgcccctctctgacgacgagaacaccaagctaaacgacacccagaagggcagcaaggtgcacgtggaggccaagtccggcatgctgacgagcgcactccgccacacctgggggttctccacgaaggaccgaaacaaccacctccaccacgccatcgacgcggtaatcatcgcctacgccaacaacagcatcgtcaaggccttctccgacttcaagaaggagcaggagagcaacagcgccgagctgtacgcgaagaagatttccgagctggactacaagaacaagcgcaagttcttcgagcccttcagcggcttccggcagaaggtactggacaagatcgacgagatcttcgtctccaagccggagcgcaagaagcccagcggcgccctgcacgaggagaccttccggaaggaggaggagttctaccagtcctacgggggcaaggagggagtgctcaaggccctggagctgggcaagatccgcaaggtgaacgggaagatcgtcaagaacggcgacatgttccgggtggacatcttcaaacacaagaagacgaacaagttctacgccgtgcccatctacactatggacttcgcgctcaaggtcctgcccaacaaggccgtggcccgcagcaagaagggcgagatcaaggactggatcctgatggacgagaactacgagttctgcttctccctctacaaggacagcctgatcctgatccagaccaaggacatgcaggagccggagttcgtgtactacaacgccttcacctccagcacggtctccctcatcgtgagcaagcacgacaacaagttcgagaccctgtccaagaaccagaagatcctgttcaagaacgccaacgagaaggaggtgatcgccaagagcatcgggatccagaacctcaaggtcttcgagaagtacatcgtgtccgcgctgggcgaggtgaccaaggccgagttccggcagcgcgaggacttcaagaagtga

SEQ ID NO: 7205 - RNA, 2955 nt, synthetic construct; identical to SEQ ID NO: 1405
  misc_feature 1..2955: note = Cas9 variant
  source 1..2955: mol_type = other RNA

SEQ ID NO: 7206 - RNA, 2958 nt, synthetic construct
  misc_feature 1..2958: note = Cas9 variant
  source 1..2958: mol_type = other RNA
atggccaagatcctggccttcgacatcggcatcagctccatcgggtgggctttcgtggagaacgacgagctcaaggactgcggcgtccgtatcttcaccaaggccgagaaccccaagaccggggagagcctggccctgccgcgacgcctcgccagatccgcccgcaagcggctggcgcgccggaaggcccgcctgaaccacctcaagcacctgatcgccaacgagtttaagctgaactacgaggactaccagtcgttcgacgagtccctcgccaaggcatacaagggcacgctgataagcccctacgagctgcggttcaaggccttaaacgagctgctgtccaagcaggacctcgcccgcgtgatactgcacatcgccaagcggcgcgggtatgacaacatcaagaacagcgacgacaaggagaagggcgccatcctgaaagcggtgaaggagaacgaggagaagctcgccaactacaagtccgtcggcgagtacctgtacaaggaatacttccagaagttcaaggagaacagcaaagagttcatcaacgtgcggaacaagaaggagtcctacgagcgctgtatcgcccagtcattcctgaaggacgaactcaagctgatcttccagaagcagcgggagttcgggtttaacttctccaagaagttcgaggaggaggtgctgagcgtcgccttctacaagcgagccctcaaggacttctcccacctggtgggcaactgcagcttcttcgtggacgagaagcgggcgcccaagaacagccccctggccttcgagttcgtcgccctcaccaggatcgtgaacctgctgaacaacctcaacaagaacaacagctacatcaaggacgacctgaacgccctgctctccgaggtgttgaagaacgggaccctgacctacaagcagacgaagaagatcctcggcctgagcgacgactacgagttcaaggggcagaagggcaactatttcatcgagttcaagaagtacaaggagttcatcaaggccctgtgcgagcacaacctcaaccaggacgacctgaacgagatcgcgaaggacatcaccctggtcaaggacgagaccaagctaaagaaggccctggcgaagtacgacctgaaccagaaccagatcgagaacctcagcaagatcgagttcaaggaccacctgaacatctccttcaaggccctgaagctcatagtgccgctgatgcgggagggcaagaagtacgacgaggtgtgcaacgagctgaacctgaagactgcaatcaacgaggacaagaaggagttcctccccgctttcaacgagacgtactacaaggacgaggtcaacaaccccgtggtgctgcgcgcaatcaaggagtaccggaaggtcctgaacagcctcctgaagaagtacgggaaggtgcacaagatcaacatcgagctggcccgcgaggtgggcaagaaccaccgcgagcggtccaagatcgaaaaggagcagaacgagaacttcaaggccaagaaggacgcggagctcgagtgcgagaagctggggctgaagatcaacagcaagaacatcctcaagctccgcctgttcaaagagcagaaggagttctgtgtctactccggcgagaagatcaagatcagcgacctccaggacgagaagatgctcgagatcgaccacatctacccctactcccggagcttcgacgactcctacatgaacaaggttctggtgttcaccaaacagaaccaggagaagctcaacaagaccccgttcgaggccttcggcaaggacgacgtcaagtggcagaagatcgagaccctggccaagaacttacccgccaagaagcagaagcgcatcctcgacaagaactataaggacaaagagcagaaggacttcaaggaccgcaacctgaacgacacgcgctacatcgcccggctggtgctcaactacaccaaggactacctggagttcctgcccctcagcgacgacgagaacatcaagctgaacgacacccagaaggggtccaaggtccacgtggaggcgaagtccggcatgttgaccagcgtgctccgccacacgtgggggttcagcaccaaggacagaaacaaccacctccaccacgccatcgacgccgtcatcatcgcctacgccaacgcgtccgtcgtgaaggccttcagcgacttcaagaaggagcaagagaactacaccgccgagctgtacgcgaagaagataaacgagctggacttcaagaacaagcgaaagttctttgagcccttctccaacttccggcagaaggtcttggagaagatcgacgagatcttcgtgtctaagccggagcgcaaaaagccctcgggcgccctgcacgaggagaccttctacaaggaggaggagttttacaaggagtacgggggcaaggagggcgtgctcaaggcgctggagctggggaagatccggaaggtcaacggcaagatcgtgagcaacgccaacatgttccgcgtggacatcttcaagtacaagaagacgaacaagttctacgccgtccccatctacaccatggacttcgccctcgggatcctgcccaacaaggcggtggtgggcgggaaggacaagcaaggcatcatcaaggactggctgctcatggacgagaactacgagttctgcttcagcctgtacaaggactccctgatcctcctgcagaccaaggacatgcaggaaccggagctggtctacttcaagagcttcaagtccagcaccgccggcctcgtggtgtccaagcacgacaacaagttcgagaacctgaacgagaaccagaagaagctgttcaagagcgccaacgagaagaaggtcgtggccgaggggatcggcatccagaacctcaaggtgttcgagaagtacatcgtctccgccctgggcgagatcacgaaggcggagatcaaggagcgggagaacttcaagaaaaagtga

SEQ ID NO: 7207 - RNA, 2961 nt, synthetic construct
  misc_feature 1..2961: note = Cas9 variant
  source 1..2961: mol_type = other RNA
atgccatccgacccggcagaagccaagccactcgaactcctggacccctacgccctacgggcacaagggctcgaccaagcccttcccctcacgcacttcggcagagcgctattccacctcaaccaaagacgcggattcaaatccaaccgcaaaacagatcgcggagacaacgaaaacggaaagataaaggacgcatcccaacggctggactgggcaatgcacgaagcaaaagcgcgaacctacggcgaatttctgcatctgcgacgccaaaaggcaccggaccccagacaagtcccaaccgtacgcacccgtctaagcgtcggcaaacgcggaggtccagacgcaaaagaagaggcggggtacgacttttacccggacagaagacacctagaagaagagtttcacgaactatggtccgcccaagcccagttccacccagaactaacacaggacctccgcgaccttgtattcgagaaaatattctaccaaagaccactaaaggaaccaaaagtaggcctctgcctattcacttcggaagaaagactcgccaaggcccatccactcacacaacgacgcgttctctacgaaacggtcaaccaattacggatcacagcagacgggcgcagcgtacgccccctaagtcgagaacaaagagaccaaataatcctagcgctcgacacaaagaaacccacaaaaagcctcaactcgatggtagtaacactacaagctctaggcaaagtactcaaactgcgagaaggagaaaggttcacgctcgaatccggagttagagaagccatcgcatgtgaccccgtccgcgcggcaatgctcgccacattcggccccagatggtccgccctagattggcccgagcaatggcaagtcatatcacgggtacggaaactccaagacgacaaagacttcgctgagctagtagaatggttaatagaattatacggtgtcgacaaggaagcagcagtcaaaatagcaaacacacacctacccgagggttacggcagacttggcctcacagcaactaccagaatcttggacagattaaaaagcaacgtattcacgtacgcacaggccgtagccgcatgcggttggcaccattccgaccaaagaacaggcgaatgcctagaccgcctaccgtactacggggccgtactggacaggcatgtcatcccaggaacatacgacgagaacgacgacgatattacgaggttcggacgaatcactaatccaacggtacacatcggcctcaaccagctgagaagactcgtgaacaaaataatcgaagtatacgggaaaccgaatcaaatcgtagtagaattagcccgagaacttaaacaatccgaacaacagaaaaacgacgccatcaaactaatcagggacacaacaaccgcagccaaacaaaggtcggagaagctggaggaactaggcataacagacaacggacgcaaccgaatgctactaagactttgggaggacctaaaccccgacgacgcgatgcgaagattctgcccatacacgggacaacggatctctgcagcaatgatattcgacggcagctgcgacgtcgaccacatactcccatactcaagaacactagacgatggcttcgcaaaccgaaccctctgtctcagagaggcaaacagagaaaagagaaaccaaacgccatgggaagcctggggcggcacccccaactgggaagccatcgaaacaaacctcaagaacctacccgaaaacaaaagatggcgctttgcaccagacgcaatggctcgctttgaaggtgaaaacgactttctcgatagggcgctagttgacacccaatacttggcacgtatctctcgaacatacctagacaccctattcacagaaggaggccacgtatgggtagtccccgggcgcctaaccgagatgctccgacgacactggggactaaactcgctccttacggacaaagacaggggagcagtaaagtccaaaaacagaactgaccacagacaccactcaatcgacgcagcagtagtagccgccaccgaccgcagtctcttaaacagaatatcaagagcggcaggccaaggagaagtggcgggccaaagcgcagaactgatagcccgagaaacaccaccaccctgggaaggcttcaggaatgatctcaaaagccaactcggacgaataatagtaagtcaccgagccgaccacggtagaatcgacagacaagcacgcaaacaaggaagggactcaaccgcaggccaactccaccaagaaactgcatacagcatagtagacgacaccagggtcgcctctcgcatcgacttcttgagcgtaaaacccgcacagctcctcgaccaacccggaagatcaggtcaagtgagggacctgcaactaagaaaagcgctacgagtagccaccggtgacctcaccggcaaagattacgaaaaagcactacgcgacttcgctgccaaacctggaccctacaaaggaatacgacgcgtccggataatcaaaccactccaggaacaagcaagagtaccagtacccgtactggaccccataaaagcataccaagggggatccaaccacgtcttcgaaatatggcatctgcccgacgggaaggtggaaccacaagtcatcaccagcttcgaggcccacgcgctagaagtagagaaaagaccccacccagccgcaaaaagactactccgagttcacaaaggggacatggtagccctaaaacgtgaaggacgcacagtcgtcgggcacgtacaacaaatgcacatcaaaaacggcctattcatcgtcccgcacaacgaagcaaatgcggacgcaagaaacagcgaccgcacagacccattcaaatggatacagatagccgcacaaccagcaatagccgcaggcatccgccgagtcgccgtcgacgaaatcggcagactccgggacggcggtgccaagacaatatga

SEQ ID NO: 7208 - RNA, 2964 nt, synthetic construct; identical to SEQ ID NO: 1408
  misc_feature 1..2964: note = Cas9 variant
  source 1..2964: mol_type = other RNA

SEQ ID NO: 7209 - RNA, 2964 nt, synthetic construct; identical to SEQ ID NO: 1409
  misc_feature 1..2964: note = Cas9 variant
  source 1..2964: mol_type = other RNA

SEQ ID NO: 7210 - RNA, 2964 nt, synthetic construct
  misc_feature 1..2964: note = Cas9 variant
  source 1..2964: mol_type = other RNA
atggcccgcatcctggccttcgacatcggcatcagctccatcgggtgggcgttcagcgagaacgacgagctcaaggactgcggcgtgcggatcttcaccaaggccgagaaccccaagactggggagtccctggccctgccgcgccggctcgcccgcagcgcacggaagcgccttgcgcggcgcaaggcccggctgaaccacctaaagcacctgatcgccaacgagttcaagctgaactacgaggactaccagtccttcgacgagagcctcgccaaggcgtacaagggctccctgatcagcccctacgagctgcgcttccgggccttgaacgagctgctgtccaagcaggattttgcccgcgtcatcctccacatcgccaagcggcgcgggtacgacgacatcaagaacaacggcgacgaggagaagtccgagatcctgaaggccatcaagcagaacgaggagaagctggtgaactaccagagcgtgggcgagtacctctacaaggagtacttccagaagttcaaggagaacagcaaggagttcatcaacgtacggaacaagaaggagtcctacgagcgctgcatcgcgcagagcttcctgaaggacgagctgaaactcatcttccagaagcagcgggagttcgggttctccttcagcaagaagttcgaggaggaggtgctgtccgtggccttctacaagcgcgccctgaaggacttcagccacctcgtcggaaactgctccttcttcacggacgagaagcgggcccccaagaacagccccctggtgttcatgttcgtggccctgacccgcatcatcaacctcctgaacaacctgaaaaacaccgaggggatcctttacaccaaggacgacctgaacgcgctgctcaacgaggtcctgaagaacgggacgctgacctacaagcagaccaagaagctcctgggcctgagcgacgactacgagttcaaaggcgagaagggcacctacttcatcgagttcaagaagtacaaggagttcataaaggcgctcgacgagcactcgctgagccaggacgacctgaacgagatcgccaaggacatcacgctcatcaaggacgagatcaagctgaagaaggccctggccaagtacgacctcaaggagaaccagatcgactccctgagcaagctggagttcaaggaccacctcaacatctccttcaaggcgctgaagctgatcaccccgctgatgctcgaggggaagaagtacgatgaggcctgcaacgagctgaacctgaaggtggccatcaacgaggacaagaaggacttcctccccgccttcaacgagacctactacaaggacgaagtgaccaaccccgtcgtgctgcgggccatcaaggagtaccgcaagatcctgaacgcgctcctgaagaagtacggcaaggtgcacaaaatcaacatcgagctggcgcgcgaggtcgggaagaaccacagccagcgggccaagatcgagaaggagcagaacgagaactacaaggccaaaaaggacgcggagctcgagtgcgagaagctgggcctgaagatcaactccaagaacatcctaaagctgcgcctgttcaaagagcaaaaggagttctgcgtgtacagcggcgagaagatcaagctctccgacctgcaggacgagaagatgctggaaatcgaccacatctacccctatagccggtcctttgacgacagctacatgaacaaggtgctcgtcttcgccaagcagaaccaggagaagctgaacaagacgccgttcgaggccttcgggaacgactccaccaagtggcagaagatcgaggtgctgaccaagaacctacccaccaagaagcagaagcgcatcctggacaagaactacaaggacaaggagcagaaggacttcaaggaccggaacctgaacgacacgcgctacatcgcccggctcgtactgaattacacaaaggactacctggacttcctccccctgagcgacgacgagaacaccaagctgaacgacacccagaagggctccaaggtccacgtggaggccaagagcgggatgctcacgtccgcgctgcgccacacctggggcttctcgacgaaggaccggaacaaccacctccaccacgccatcgacgccgtgatcatcgcctacgccaacaactccatcgtcaaggcgttcagcgacttcaagaaggagcaggagagcaactccgccgagctgtacgcgaaaaagatcagcgaactggactacaagaacaagcgcaagttcttcgagcccttctccgggttccggcagaaggtgctggacaagatcgacgagatcttcgtcagcaagccggagaggaagaaaccctccggcgccctccacgaggagaccttccggaaggaagaggagttctaccaaagctacggcgggaaggaaggcgtgctgaaggccctggagctcgggaagatccgaaaggtgaacggcaagatcgtcaagaacggggacatgttcagggtggacatctttaagcacaagaagacgaacaagttctacgcggtgcccatctacaccatggacttcgccctgaaggtcctgcccaacaaggccgtggcgcgctccaagaagggcgagatcaaggactggatcctcatggacgagaactacgagttctgcttcagcctgtacaaggactccctgatcctcatccagaccaaggacatgcaggagccggagctggtgtacttcaatgcgttcacctcttctacggtcagcctgatcgtgtcgaagcacgacaacaagttcgagaccctcagcaagaaccagaagatcctgttcaagaatgccaacgagaaggaggtgatcgccaagtccatagggatccagaacctgaaagtcttcgagaagtacatcgtgagcgccctcggggaggtgaccaaggctgagttccggcagcgcgaggacttcaagaacgagctgcggtga

SEQ ID NO: 7211 - RNA, 2964 nt, synthetic construct
  misc_feature 1..2964: note = Cas9 variant
  source 1..2964: mol_type = other RNA
atggcccgcatcctggcattcgacatcggcatcagctccatcgggtgggcgttcagcgagaacgacgagctcaaggactgcggcgtgcggatcttcaccaaggccgagaaccccaagaccggggagtccctggccctgccgcgccggctcgctcgcagcgcccggaagcgtctggcgcggcggaaggctcggctgaaccacctcaagcacctgatcgccaacgagttcaagctgaactacgaggactaccagtccttcgacgagtcactcgccaaggcgtacaagggctccctgatcagcccctacgagctgcgcttccgggccctcaacgagctactgtccaagcaggacttcgcccgcgtgatcctccacatcgccaagagacgcgggtacgacgacatcaagaacagcgacgacaaggagaagggcgccatcctgaaagcgatcaagcagaacgaggagaagctggccaactaccagtccgtgggcgagtacctgtacaaggagtacttccagaagttcaaggagaacagcaaggagttcacgaacgtgcggaacaagaaggagtcctacgagcgctgcatcgcccagagcttcctgaaagacgagctgaagctcatcttcaagaagcagcgggagttcgggttctccttcagcaagaagttcgaggaggaggtcctgtcggtggccttctacaagcgcgccctgaaggacttcagccacctcgtgggcaactgctccttcttcaccgacgagaagcgggcgcccaagaacagccccctggccttcatgttcgtcgccctgacccgcatcatcaacctcctgaacaacctgaagaacaccgaggggatcctctacacgaaggacgacctgaacaccctgctcaacgaggtgctgaagaacggcaccctgacctacaagcagacaaagaagctcctggggctgagcgacgactacgagttcaagggcgagaagggcacctacttcatcgagttcaagaagtacaaggagttcatcaaggccctcggggagcacaacctgtcccaggacgacctgaacgagatcgccaaggacatcaccctcatcaaggacgagatcaagctgaaaaaggcgctggccaagtacgacctcaaccagaaccagatcgacagcctatccaagctggagttcaaggaccacctcaacatcagcttcaaggccttgaaactggtgaccccgctgatgctcgaaggcaagaagtatgacgaggcctgcaacgagctgaacctgaaggtcgccatcaacgaggacaagaaggacttcctcccagcgttcaatgagacgtactacaaggacgaggtgaccaaccccgtggtcttaagggccatcaaggagtaccgcaaggtgctgaacgccctcctgaagaagtacgggaaggtgcacaagatcaacatcgagttagcccgcgaggtcggcaaaaaccactcccagcgggcgaagatcgagaaggagcagaacgagaactacaaggccaagaaggacgccgagctcgagtgcgagaagctgggcctgaagatcaacagcaagaacatcctcaagctgcgcctgttcaaggagcagaaggagttctgcgcctactccggggagaagattaagatcagcgacctccaggacgagaagatgctggagatcgaccacatctacccctacagtcgcagcttcgacgactcctacatgaataaggtgctcgtgttcaccaagcagaaccaggagaagctcaaccagaccccgttcgaggccttcggcaacgacagcgcgaagtggcagaagatcgaggtcctggccaagaacctacccacgaagaagcagaagcgcatcctcgacaaaaactacaaggacaaggagcagaagaacttcaaggaccggaacctgaacgacaccaggtacatcgcccggctggtgctcaactacaccaaggactacctggacttcctgcccctctccgacgacgagaataccaagctgaacgacacgcagaaggggagcaaggttcacgtcgaggccaagtccggcatgctgaccagcgccctccgccacacatgggggttctccgcgaaggaccggaacaaccacctccaccacgccatcgatgctgtgattatcgcctacgccaacaatagcatcgtgaaggccttctccgactttaagaaagagcaggagagcaacagcgccgagctgtacgccaagaagatctccgagcttgattacaagaacaagcgcaagttcttcgagcccttcagcggcttccggcagaaggtcctggacaagatcgacgaaatctttgtgtctaagccggagagaaagaagccctcaggcgctctgcacgaggaaaccttcaggaaggaagaggagttctaccagtcctacgggggcaaggaaggggtcctcaaggcgctggagctgggcaagatccgcaaggtgaacgggaagatcgtgaagaacggtgacatgtttcgggtcgacatcttcaagcacaagaagacgaacaagttctacgccgtgcccatctacaccatggacttcgccctcaaggtgcttcccaacaaggccgtcgcccgcagcaagaagggcgagatcaaggactggatcctgatggacgagaactacgagttctgcttctccctctacaaggacagcctgatcctgatccagaccaaggacatgcaggagccggagctcgtgtacttcaacgcgttcacctccagcacggtgtccctgatcgtcagcaagcacgacaacaagttcgagaccctgtccaagaaccagaagatcctcttcaagaacgccaacgagaaggaagtgatcgccaagagcatcgggatccagaacctgaaggtgttcgagaagtacatcgtctccgcccttggcgaggtgaccaaggccgagttccggcagcgtgaggacttcaagaacgagctccggtga

SEQ ID NO: 7212 - RNA, 2964 nt, synthetic construct; identical to SEQ ID NO: 1412
  misc_feature 1..2964: note = Cas9 variant
  source 1..2964: mol_type = other RNA

SEQ ID NO: 7213 - RNA, 2964 nt, synthetic construct; identical to SEQ ID NO: 1413
  misc_feature 1..2964: note = Cas9 variant
  source 1..2964: mol_type = other RNA

SEQ ID NO: 7214 - RNA, 2979 nt, synthetic construct
  misc_feature 1..2979: note = Cas9 variant
  source 1..2979: mol_type = other RNA
atgcgcatcttcagtgacgggaggaaccccaaagacggctcaagtttagccgtcaccaggcgagcagcaagggcgatgagaaggcgacgagacagactactgaaacgaaaaacgcgaatgcaagccaaattagtcgaacatggtttcttcccagcagacgccggaaagagaaaagcactcgagcaactcaacccctacgccctccgagccaaaggactacaagaggcactacttcccggcgagttcgcacgcgccctattccacatcaaccaaagaagaggattcaaaagcaataggaagacagacaagaaagataatgacagcggagtactgaagaaggctataggacaactacgacaacaaatggccgaacaaggaagcagaacggtaggggagtacctatggacgaggctccagcagggacaaggagtaagagcccgctacagagaaaaaccttacacaacagaggaagggaagaaacggatcgacaaaagctacgacctatacatagacagagcaatgatcgaacaagagttcgacgcgctctgggcagcccaggccgcattcaaccccacactattccacgaagcagcgcgagcagacctaaaagacaccctcctccatcagcggccactacggcccgtcaaaccaggccgctgcaccctgctcccagaagaagaacgagcaccactagcactcccgagcacacaacgcttccgaatacaccaggaagtaaaccacctccgactactagacgaaaacctaagggaggtggcactaacactggcacagagagacgcggtggtcacagccctagaaacgaaggcaaaactctcctttgaacaaatacgaaaactactgaaactaagcggcagcgtgcaattcaacctagaagatgcgaaacgcaccgaactaaagggcaacgccacgtccgccgcactcgccagaaaagaactatttggagcagcatggtcaggatttgacgaagcactccaagacgaaatcgtatggcagttggtcacagaagaaggcgaaggggcgctaatcgcatggctacaaacacataccggcgtggacgaagcaagggcacaagccatcgtcgatgtaagcctgccagaagggtacggcaacctcagtagaaaagccctagcgcgaatcgtcccagccctaagagctgcagtaatcacctatgacaaagctgtacaagcagcgggcttcgaccaccactcccaactcggattcgaatacgacgcatccgaggtggaagacctcgtacaccccgagacaggcgaaataaggtcggttttcaagcaactaccatactacggaaaggcgctccaaagacacgtggcctttgggagcggaaaaccagaagacccggacgaaaaacggtatggcaaaatagcgaatccaacagtacacatcggactaaaccaggtacgcatggtcgtgaacgcactaatccgaaggtacggacgccccacagaagtggttatcgaactcgcccgagacctcaaacagagccgggaacaaaaagtcgaagcccagcgccgccaagcagacaaccagcgcagaaacgcacgaatacgccgatccatagcagaagtcctcggcataggcgaagaacgcgtcagaggatctgatatccagaaatggatatgctgggaggaactgagcttcgacgcagccgacagaagatgcccgtacagcggagtgcagatctccgccgccatgctcctcagcgacgaggtagaagtggaacacatactcccattcagcaaaacgctggacgatagcctaaacaacaggacggtagcaatgaggcaagcaaatagaataaagcgcaaccgaacaccatgggatgcgagagcggagttcgaggcccaaggctggtcgtacgaggacatcctacagagagccgaacggatgccacttaggaaaaggtaccggtttgccccggacgggtacgaacgatggttaggcgacgacaaagacttcctagcgcgagcactaaacgacacacgctatctcagccgagtcgcagcagaatacctaaggctagtatgcccaggcacaagagtgatacctgggcaactcacagcattactacggggaaagttcggactaaacgacgtgctaggcctagacggagagaagaacagaaacgaccatagacaccacgccgtagacgcctgcgtcataggcgtcaccgaccaaggcctaatgcagcgcttcgcgaccgcctctgcgcaagcgagaggagatgggcttacacgactcgtcgacggcatgccaatgccttggccgacatatagggaccacgtagagagagccgtaagacacatctgggtgagtcaccgaccagaccatggattcgaaggagccatgatggaggagacaagctatggcatcaggaaggatggatccataaaacaacgcagaaaggcggacggaagcgccggacgagagataagtaacctcatacggatccacgaagcgacacaaccactacgacacggagtctccgcagacggccagccactcgcatacaaagggtacgtaggaggtagcaactactgcatcgaaatcaccgtaaacgacaaaggcaaatgggagggggaagtcataagcacctttagggcctacggggtagtaagagcaggagggatgggccgactacgcaacccacacgaaggacaaaacggaagaaaactaataatgcggctagtcatcggggatagcgtaagactcgaagtagacggcgcggagagaacaatgcgcatagtgaaaatcagcgggtcaaacggccaaatattcatggccccaatccacgaggcgaacgtagacgcacgcaacacggacaagcaagacgcattcacctatacgagcaagtacgcagggagcctacagaaagcaaaaaccagaagggtaaccatatcaccaatcggcgaggtcagagacccaggcttcaagggctga

SEQ ID NO: 7215 - RNA, 2985 nt, synthetic construct
  misc_feature 1..2985: note = Cas9 variant
  source 1..2985: mol_type = other RNA
atgaccctcggactcgacctcgggacaaacagcatcggctgggccctaatagacttcgacgacaaccaacaaccacgcaacctcatagcctgtggctcaaggattttccaagaggcagtcgaagccaaaaccggaacccccaaaaaccacgccagacggacagcaagagccgcacgcaaactcgtagcccgtcgaaaacagcgccgcaccaagctactcaacctactcatacgtcacggactactcccacaggacgtagccgagcgcaacgcccttctgcttgacaaccaggccaacaacccgtaccagctccggaagcgcgggctcgacgaaaaactcgaaccattcgcctttggccgcgctctctatcacctcgcacaccgccggggtttccagagcaaccgtaaagctgcctccgacgaggacggaaaggtcaaaaccgccataagcacactaagggccgaaatgcagggtcgcacactcggcgcgttcctcgcggaccagcccacccaacgaagacgatacaccgaccgcgccatgtacgtggaagagttcgaacagctttggagcaagcaggccagcttcacccaagaacaacttactcaagcactaaaagtagcaatacacaactcaatattcttccaaagacccctcaaatcccagaaacacctagtcggcaaatgcacattcgaacccacacgcaaacgagccgcaaaagcaattctactaacgcaacgcttccgcatcctccaggacgtgaaccacctcgccgtcaaaaaccccatcacccgcgagttccgacccctcacccaagacgaacgaaataaacttgcagaagccctcgacaaacaaaaatcaatgacctggggagccgtccgaaaagtaatcgggtggaacaagaaagacagcttacacgagggcgagacattcaatctcgaagagggcaagaaagacaaactcatcggcaaccgcacggcgtgcgatctccgaggggcactgggcgaccggtgggacgcactcaccgcccagcaacaggacgacctcgtcaccgacctactcacaatcgacaacacagacggctttctaaaacggatgaaaacccactgggagttcgacgacgccacagcggaagtaatcgcaaaaatcgaactagagccaggctacgcccgcctctccgcaaaagccatgcgagccatcctcccatacctagaacaaggcatgatttactcggacgcctgcaaagccgccggctacgaccactccaaccccaaccaaaggaccatcactgacaaactaggacttccttcgaacgtccgcaacccagtcgtgcaaaaagcactcttcgaaacccgcaaagtagtgaacgcaatcgtccgaaaatatggaaaacccgcagtaataagagtcgaaatggcccgcgacatgaaactcagcaaacgccaaaaggaggaactgcaaaaagagcagaacaaacaaaagaaagctaacgaactggcagaaggaatactcagaaaagagttcggaatccaacaacccgcccgcgcggacattcaaaaatacaacctttggctcgaatgcaaagaagtatgcccgtacacagggaccaccataagtcgagaaatgcttttcagccccgaggtcgacgttgagcatatcctcccgtatagccgttcactcgacgactcttacatgaacaaaacgctatgcatggcaaccttcaacagacaggtcaaactaaacaacacaccctacgaaataggacagggggacccactagcctacgcagaaatcttccaacgcataaaaacactccccttccccaaacgacgccgattcgaacaaaaagaaatagaaaccgacaaattcatagaacgccaactcaacgacactcgctacatctgcgtggaagtacgcgacttcctacaacagctcggagcaccggtagaagtaagcaaaggagaagccaccgccaaactccgtgggcgctggaaactgaacacacttctaagccccgacggaagcaacgaaaaatatcgcggagaccaccgacaccacgccatcgacgcggtagtaatcgcgctcacaaaccggtccctattccacaaactctcccgcctctccgcccaaagcatctcactcgacaagagcagattcgacgtgcccccaccctgggacggattttacgacgacgtctacgagaaaatcgataaagttatagtatcgcacgcacccgcgcgcaaaataggaggcgcactacacgaagacacagcatacgggcacttcaaagaagaagtcgcagacccaaaaacagggaaagtatctatcgaggatcgcttcgtctaccgcaaaccccttgccacccttaccgccaatgaagtgggtaaaattcgggacgccaaagtccgcgagttcgtagaagctagactcgctcaattcggcaataacagcaaaaccgccttcggcgaccctaacaaccctctcctacacgccgacggtaaaaccccaattagaaccgtcagattagtaacaaacttcaataaggccactactcacgcaatccaaaaaggccaaggtcgagactataaattctttaaatacggtaacaatcaccacgtcgaaataatcgaacacgtcgagacgggaaaaaggaagggaatcttcgtaacagcaatggaagcagcacgccgcgtgcgcggagtcgccaacaccgaaaaatccgacatcgtccaacgaaaccacggcgaagagtggcgattcgtcatgtcactcagcataaacgacctcgtgagcatacaggaagccgaccaggtacgcatcatgcgggtacaactcttcgacgcgtccaatggcaacataatcttcagagaccagaaaagcgccatgctagacgacaaacttagccggtaccaaacaaaggcccacctactcgtatgccagaaaataaccacagatcccctaggcaacctcgccccctgcaacgattga

SEQ ID NO: 7216 - RNA, 2988 nt, synthetic construct
  misc_feature 1..2988: note = Cas9 variant
  source 1..2988: mol_type = other RNA
atgagcaaagtgctaggactcgacatcggcgcaaacagcattggctgggcactcatcgacgacgaagaaaacgacatcattggggccggcgtccgcgttttcaaagaaggcgtcaacctgaaaggcgtaaaggaggaaagtaaaaacgtcgagcgccgagcagcgagactcgcccgccgccaacacaaaagacgctcacaaagacgtaaccgcctcgtagcgctgctcaaaaccctcgagatgttccctgaaaacaacgaagacatctccgactattacgcccaagacccatacgaactacgcaaaaagggactatatgaaaagctaacgatgtacgagttcggaagagtcctgctacatatatgccgaagacgaggattcaaatcatcccgaaagacggacatcagcgaagaaggaaaaatattcgagggcaaagacggcattgtagggataaaccaaacccgcgacagcatacgagaaggaggctttaaaacaatcggggaatacctcgcctcactggacccacacgtaattcgccgacggaatagattcacactacgagacatgtacgaagaagagttcaacttaatgtgggaaaagcaacaatcattctacccactacagctcagcaacgagttcaaagaagcaatcgccgaagtaatcctcagccaaaggaaactcaagagccaaaaagcactcgtgggtaactgcggattagagccaaacaagaaaacggcgcccaaatccagcccagcgttccagtacttccggatcctagagcagctatcccgtattctcataagcatcccacacacaggtcgatacaacgacccgctcaatgaagaagaacgtcgcatgctcatcgacaaactgtcagtaacagaaaaattgaagttctccgacatgcgcaaaatgctcaacctccccggggagtcagacataaacatcgaggaagaaggagggagactactcgggaacacaacatacgcgcggctgatcaaggtattcggaaagaagcgctgggcaggcttcagcgaagaagaaaaagaacaaatatggcacaccttccacttcgccgacaaccacgaatggctaaaagaatacgcactcaagaaatggagtatcacgcccgacgaaataaaagaactcgggaaagtggccctagaaaaagagtacgcccgattcagtaagaagtccctcaagaaaatcataccccaactagaggaagggttaaccctagataaagccaaaatcgaagcgggctacacaccagaatacgagatagagaaatctctgtcagcttacttgcccctccccgaaaatatacggaatccaatcgtacagcaggcactttacgagctacgccacgtggtaaacgccgtaataagaacctacggaaagcccgacatcgccagagtcgaactagcacgcgagatgaagaagcccaaacagaaacgtgagaaaatgcgatccgaactacgcaaaaggcaaatgaaatttgaagaaataaaatccatcctaaaagaacgactgggcttcatcgatcctaaacgagacgaaatccacaagtacatgctatgggaggagtgcagagagacatgcccctacaccgggcgcaagatcagtctctcagcactctacggaggagacttcgaggtcgagcacataattccatacaaaagaagcctcgacgacagtcttttcaacaagacagtgtgcctcagagaagaaaaccagataaaaggcgaccgcaccccatacgaggcctacagtggcgaccgccaaaagtacgaagaaataatacttcgggtacaaaagaccagtatgccgcgcggaaagaaaaacctattcgccataaaagaactaaaagacgatttcgcccatcgccaactcagcgataccgcctacatctccagagaaacacgaaaatacctcggcagcacaatcaaaaaggtacaagcagtcaaaggcggatccacagccaaactacgatactactggggactcaacagcatactcggcgtccgtgacataaaaatgcgagacgaccaccgccaccacgcagtggacgcgttagtcatcgccaacacgacatacgccttcgtaaataccttatccagataccactccatggacgtggaaccccacgaatcacgcttccccttgccgtgggagcagttcaggaacgacgcagaatccgtcgtaaggaacatctttgtaagccaccggctcggcaagaaagccacaggccagcttcacgaagaaacatactacggcaaaatcagaaacaccgatggagaaccctatttcgtagtccgaaagaaactaggcacgctaaccgcgaaacaaatagcaaacatcgtcgaccccgtcgtaaaaacccaagtcttcgaacgcctcgaagaaaaaggcatcgacatagaatcatcgaataaaatcccagcggacgccttcgtcgaaaccctatacatgccagaccgcaaaacgccaatcaaatcagtccgagtgaaggtaccgagtacaacaatgatacaactgtacaaggacaaagaactgtacgtagatccgggctcgaaccaccacatcgtaatattcgaaaacgaggagggaaaaagagacggaatcgtcgtgtcactcttcgaggccgcacagcgcctacgccgcaacgaacccgtcatccaaaagacatggaagccggaatggcacttcgtgatgtcgctctccatagacgaactcatcctgctagacgtcgacgaaaagaacatcgattggggagacacagggctggcactcagatacagcaaagccctataccgagtccagaaaatggacgtcaacaaaatcataacgctgcggcatcacctcgtagcaaggctcaaagacgacgaaggaaaagagttcggacgagaacatcgcatccccagcacgctccgaggactcaaagtaaagatagatcacataggacgcctccgtcgagcctatgactga

SEQ ID NO: 7217 - RNA, 2988 nt, synthetic construct; identical to SEQ ID NO: 1417
  misc_feature 1..2988: note = Cas9 variant
  source 1..2988: mol_type = other RNA

SEQ ID NO: 7218 - RNA, 2988 nt, synthetic construct; identical to SEQ ID NO: 1418
  misc_feature 1..2988: note = Cas9 variant
  source 1..2988: mol_type = other RNA

SEQ ID NO: 7219 - RNA, 2991 nt, synthetic construct
  misc_feature 1..2991: note = Cas9 variant
  source 1..2991: mol_type = other RNA
atgatgggaaacttcacactcgggctagacctcggcaccaactccatcggttgggccctaatcgacttcgacgacaaccagcaaccccaaaacctcatcgcctgcggttcccgcatctttcaagaagcagtagaggcaaaaacaggcacacccaaaaaccacgcgcgtcgcgccgctcgcgctgcccgaaaacttgtcgcacgaagaaaacagcggagaacaaaactactgaacctcctcgtatgccacgacctgctaccacaagacgaggcagaacgtaatgcacttctactagacaaccaagccaacaacccatatcaactacgcaaacgcggcctcgacgaaaaactcgaaccattcgcattcgggagagcactctaccacttggcccatagaaggggattccaaagcaacaggaaagcagcctcggacgaagacggcaaagtcaaaaccgccatctcagccctacgggcagaaatgcaagggcacacactgggcgcattcctcgccgaccaaccaacccaacgccgaagatacacagaccgtgccatgtatgcggaagagttcgaacagctatggagcaaacaaacaatcttcgctcctgaacaactcacacaggccctcaaagtagagatcaaaaactccatattctttcaacgccccctaaaaagccaaaaacacctcgtcgggaaatgcaccttcgaaccgacaaggaaaagagcagccaaggccatcctcctcgcccaacatttcagaatcctccaagatgtaaatcacctcgcagtcaagaatcccattacgcgagagttcaggcccctaacacaggacgagcgcaacaaactagccgaagcgctagacaaacaaaaaggtatgaactggagtgcggtacgtaaagtcatcggctggaataagaaagactccctccacgaaggagaaacgtttaacttagaagaaggcaagaaggacaaactaatcggaaaccgaaccgcctgcgacctccggggagccctaggcgaccgatgggacgccttcacagcgccccaacaagacgacctcgtcaccgacctcctgacaatcgacaatcccgacgggttcctaaaacgcatgaaaacccactggggcttcgacgacgctacggctgaagcactagccacaacagagcttgaacccggatacgcccgcttgtcctccaaagccatgcgcgcaatattaccccacctggaacagggaatgatttactcagatgcctgcaaagccgctggctacgaccacagcaaccccaaccagcgcacaatcacagacaagctcggtctaccctccaacgtacgaaacccagtcgtccaaaaggcgctgttcgaaacccgtaaagttgtaaacgcaattgtccgaaagtacgggaagcccgcagtcatccgcgtagaaatggccagagacatgaagttatccaaaagacaaaaagaggaactacagaaagagcaaaacaaacaaaagaaagcaaacgaactcgccgagggaatccttcgaaaagagttcggcatccaacaacctgcgaggacagacatacaaaaatataacctctggctcgaatgcaaagaagtgtgcccatacaccggcacggtaatctcccgagaaatgctctactcaccagaagtggacgtagaacacatcctgccctatagccgatccctagacgactcttacatgaataagacactttgcatggcaacatacaaccgccagacaaaactgaacaacaccccctacgaaatcggtcaaggcgaccctgtcgcgtatgccgagatcttccaaagaatcaaaaccctaccattcccaaaacgacgaagattcgaacaaaaagaaatagaaacagacaaattcatcgaaagacaactaaacgacacccgctacatctgtgtagaagtgcgtgactttctccagcaactcggcgcacccgtagaagtctctaaaggtgaagccaccgctaaactccgcggtcgctggaaactaaacaccctactaagccccggcggcggcaacgaaaagaaccgagcagaccaccgccaccatgccatcgacgcagtagtcatagcgctaaccaaccgatccctcttccataagctctcacgcctaagcgcacaatccatatccttcgacaaatctcgctttgacgtcccaccaccctgggacgacttctacgacgacgtctacgaaaagatagataaagttatcgtcagccacgcccccacccgaaaaatctcaggcgcgctccatgaagcaacagcatacggacacttcaaagaagaaatcgcagatcccaaaacaggaaaattcagcattgaagacagatttgtgtaccgaaagcctctaactacactcaccgctaacgaagtcggcaagatacgagacgctaaagtacgagagctagtcgaagcccgactggcccaattcggaaacaactccaaggccgcattcggagatccaaacgaaccgttactacacgccgacggcaaaaccccaatccggaccatccgcctaacgaccaacttcaacaaaaccaccacccacgccatacaaaagggccaagaccgagactacaaattcttcaaatacggcaacaaccaccacgtagaaatcatcgagcacgtggaaacaggcaaacgaaaaggcatattcgtaaccgcaatggaggcagcccgtcgagcacgcggcgtcgccaacaccgaaaaatccaacattgtccaacgcaaccacggcgatgggtggaaattcgtcatgtctctagctgtgaacgacatggtcagaactgaagacacgcaagcgatataccgcgtccaaaaactcgacggaagcaacaatagattcaccctccggtcccacaacgccgcaaccctcgatgacaaacaaacaggcgtcgacaaaacaccaaacctattcaagggaaccaaaatcatagtcgacccgttgggaaacctaacccagtgcaacgactga

SEQ ID NO: 7220 - RNA, 2994 nt, synthetic construct
  misc_feature 1..2994: note = Cas9 variant
  source 1..2994: mol_type = other RNA
atgaaagtattagtagacgcaggcctcatgccaagcgacccagccgccgcaaaagcactagaaacactcgacccatacgaactgagggccaccgggctagacgtgatgctgcccctaacacacctaggcagagcagtatttcacctaaaccaacgccgcggattcaagtccaaccgaaaaaccgacaggggcgacaacgaatcaggaaaaataaaagacgccaccaagcgactaacatgggccatgcaagaagccggggccagaacctacggcgagttcctacacatgagacgagcccgagcgagcgaccccaggcaagtgccaagcgtccgcacacgactaagcgtcgcaagcagaggcggacccgacagcaaagaagaagccggatacgacttctaccccgaaagagcacacctggaagatgagttccatgcactatggtctgcccaagccgcattccatcccgacctcacatgcgaactgagggatgtcgtattcgaaaagatcttctatcaaaggcctctaaaggaacccaaagtaggactctgtctattcaccgccgaagaaagactaccaaaagctcatccactcaccgggcgaagggtcctatacgaaaccgtcaaccaactccgggtaacggccgacggacgaaccacccgaccacttacgctagaagagagagacatgatcgtgtacgccttagacaacaagaaaccagtcaaatcactaagctcaatgcaccttaaactggtagccctgggaaaactcgtaaaactaaaggacggcgaacgcttcaccctcgaaagcggagtgcgggacgccatcgcctgcgacccaatacgcgccaccatgggacatccagacggattcgggcccgcatggtcacgactagactggcaggcccaatgggcactcatagagaaactgaggcaagtgcagtcggacgacgacttcgcgagcctggtagcatggctgggagcgacccacaatctaagcgaggaccacgcaaaaagagtagcaaacctgcacctaccagagggctacggcagattaggactaacagcaacagaagcgatactatgcaacctcaaagcggaagtatgcacatacagccaagcagtcgaaagatggggaaagcaccacagcaaccaacggacaggagaatgccttgaggctctcccatattacggcgaagtactcgacagacatgtaattcccgggacgtacaacgaagacgacgacgacgtgacacgctatggacgaatcacaaaccctacagtacacataggtttaaaccagctgcgaagactcgtcaacagaataatcgcaacctacggcaagcccgatcaaatagtcgtggaactagcccgagagcttaaacaaagcgaggcccagaagtccgaagccctcaagaaaataagagacacaacagccgacgcaatacgcagaggccgacaactcgaggaaatagggcagaaaaacaccggcgccaacagactactactccgattatgggaagacctaggaccagccgtcggcccaagatgctgcccctacaccggcaaaccgatctcagtaactatgttattcgacggggcatgcgacgtcgaccacatcctcccatattcaaggacactagacgactcgttcgccaacaggaccatatgcctccgagaagccaaccgacaaaaaggagaccgaacgccatgggaagcctggggagggtccgaccagtgggacgcaatcgaggccaacctgaaagacctacccgaaaacaaacgcaaacgatttgcacccgacgccatggaacgcttcgagggggaacgcgacttcctcgaccgagccctagtcgacacacagtacttggcgaggatatcacgggcgtacctagacaccctattcactgaaggaggccacgtgtgggtagtaccgggacgaatgacagaaatgttaagacgacactggggtctaaacgcactgctgagcgacaaagaccgcggcgcaggaaaggtgaaaaacagaaccgaccaccgacaccacgcgattgacgcggccgtaatagcagcgacagaccatagcctcgtaaaccgaatctctaaagcagcaggccaaggagaaagcgcaggccagtccgccgagctaatagccagagacacaccagaaccctgggaaggattcagaaacgacataagcgcacaaatagcacggattgtagtcagccaccgagcagaccacggaaggatagacgtagaaggccgcaaacacggcaaagactccacagcaggccgactacacaacgacaccgcgtacgggatcgtagacgaccacacagtcgtgagccgaaccccgctattatcactcaaacccggagacatagaagtaaccacaaaaggcaaaaacatacgagatacgcaactccaaaaagccctatcggtagcgactacgggaaaggacgggaaaggattcgaggaggcactacgcaacttcgccgagaaagaaggaccataccaaggtatccgacgggtccgtctcatcgaaacactacaaagctcagcgagggtagaggtagggagcgacgaagacggccaacccctcaaagcatacaagggggactccaaccattgctacgacctatggaagctacccgatggaaaggtagtaccacacgtagtcagcacgtacgaagcacatgccggtaccgacaagagaccacacccggctgccaaaagaatactgcgcgtatttaagaaagatatggtcgccatagaacaagacgaccaaaccgcgatattttacgtacaaaaactagacagggcaaacggcctattcctcgcaccccacctagaagccaacgcagacgcacgccaccggaacccaaacgacgccttcaaattcctccaaatgggggccggaagcgttgtcagaaacaaactccgaagagtatacgtagacgagataggaagaataaaagaccccgggcccccaaaacactga

SEQ ID NO: 7221 - RNA, 2994 nt, synthetic construct
  misc_feature 1..2994: note = Cas9 variant
  source 1..2994: mol_type = other RNA
atgaagatcctgggcttcgacatcgggatcaacagcatcggctgggccttcgtggagaacgacgagctcaaggactgcggggtccgcatcttcaccgaggccgagaacccctccaacaaagagagcctggcgctgccgcggcgcaacgcccggtccagccgccggcgcctcaagcggcgcaaggcccggctggtagccataaagcgcatcctggccaaggagctcaagctgaacttcaaggactacgtggcggccgacggcgagctgcccaaggcctatgaggggaagctcacctccatctacgagctgcggtacaaggccctgatccagcagctcgagacgaaggacctggcgcgcgtcatcctgcacatcgccaagcaccggggctacatgaacaagaacgagaagaagtccaacgacaccaaaaagggcaagatcctcagcgccctgaagaataacgccctgaagctagaaaactaccagagcgtgggggagtatttctacaaagagttcttccagaagtacaaggaaaacaccaagaacttcatcaagatccgcaacaccaaagacaactacaacaactgcgtactgtccagcgacctggagaaggagctcaagctgatcctggagaagcagaaggagttcggttacaactactccgaagacttcatcaacgagatcctcaaggtcgccttcttccagcggcccctgaaggacttcagccacctggtgggggcgtgcacgttcttcgaggaagagaagcgcgcctgcaagaactcctactcagcctgggagttcgtggccctcacaaagatcatcaacgagatcaagtccctggagaagatcagcggcgagatagttcccacccagaccatcaacgagatcttgaacctcatcctggacaaggggtccatcacgtacaagaagttccggagctgcatcaacctgcacgagtccatcagcttcaagagcctcaagtacgacaaggaaaacgccgagaacgcgaagctgatcgacttccgcaagctggtggagttcaagaaggccctcggtgtgcactccctgagtcggcaggagctggaccagatctccacccacatcaccctcatcaaggacaacgtcaagctgaagaccgtgctggagaagtacaacctcagcaacgagcagatcaacaacctgctggagatcgagttcaacgactacatcaacctctccttcaaggccctgggcatgatcctgccgctcatgcgcgaggggaagcggtactacgaggcctgcgagatcacgaacctgaagcccaagaccgtagacgagaaggaggactttctgcccgcgttctgcgacagcatcttcgcgcacgagctgtcgaaccccgtcgtgaaccgcgccatcagcgagtaccgcaaggtgctcaacgcgctgctgaaaaagtacggcaaggtccacaagatccacctcgagttggcccgggacgtggggctgtccaagaaggcccgcgagaagattgaggaccagcagaagaataacaaggcgatcaacgactgggccctcaaggagtgcgagaacatcggcatcaaggcgagtgccaagaacatcctgaagctgaagctctggaaagagcagaaggagatctgcatctactccggcaacaagatcagcatcgagcacctgaaagacgagaaggcgctggaggtggaccacatctacccgtactcccggtccttcgacgactccttcatcaacaaggtcctcgtgttcaccaaggagaaccaggagaagctgaacaaaacccccttcgaggccttcgggaagaacatcgagaagtggagcaagatccagacgctggcccagaacttgccctacaagaagaagaacaagatcctggacgagaacttcaaggacaagcaacagcaggacttcatctcccggaacctgaacgacacccggtacatcaccaccctcatcgccaaatacacgaaggagtacctgaacttcctgcccctgagcgagaacgagaacaccaacctgaagtccggcgagaaggggagcaagatccacatccagaccatcagcggcatgctgacctccgtgctccgccacacgtgggggttcgacaagaaggaccggaacaaccacctacatcacgccttggacgcgatcatcgtcgcctactccacctccagcatcatcaaggccttctccgacttcaagaagaaccaggagcttctgaaggcccgcttctacgccaaggagctgaccagcgacaactacaagcaccaggtgaagttcttcgagccattcaagggcttccgggagaagatcctctccaagatcgacgagatctttgtcagcactccgccccgcaagcgggcccgcggcgccctgcacgaggagacgttctactccgaggacaagatgatcaagaagtacaacagcaaggaggggctgcaaatcgccctcagctgcggacgggtgagaaagatcgggaccaagtacgtggagaacgacaccatggtccgggtggacatcttcaagaagcagaacaagttctacgccatccccatctacgtgatggacttcgctctgggcatattacccaacaagatcgtcatcaccggaaaggacaagaacaacaaccccaagcagtggcagactatcgacgagagctacgagttctgcttctccctctacaagaacgacctgatcctgctccagaagaagaacatgcaggagcccgagttcgcgtactacaactctttcgacatagaccgctcccggatcaagatcaagaagcacgacaacaagttcgagaacctgaccagcaaccagaagctgctgttcaccaacaaggacaagggcaagaaccgcaccggcatccagaacctgaagatcttcgagaagtacatcgtgacgcccctgggggacaagatcaaggccgacttccagccgcgggagaacatctccctcaaaaccagcaagaagcacggcctgtga

SEQ ID NO: 7222 - RNA, 2994 nt, synthetic construct
  misc_feature 1..2994: note = Cas9 variant
  source 1..2994: mol_type = other RNA
atgggcaattacacactaggactagacataggcagcaattcaatagggtgggcgctagtcgaggacgcagtagaagcaccccggatcgtggacatgggagtcagagtcttcccagaaggagtagaccgagacacgaagggcctagaaaaatcgaaaaacgcaactagacgagaggcacggggtgcacgacgaacacatcaacgacgccgccaacgaaaacaaaggctagtaagagcactccgacaggtcgggctcctaccatgcgacaaagcagaagtacggtccctattccaaaccgacccatacgaaatacgcaaacgcggcctcgaccacagactagagctatacgaaataggccgtgcattctaccatctatcccaacgtcgggggttcaaatccaaccggaaaagcggggccctaaaggaagacggaactgttaagaaagaagccggagaactccagagaaaaatagacgaagccgggtgtaggacgatcggagagtacttcgcaggtctagacccagagcagcagcgcatccgtggccgctataccttccgaagcatgtaccagaaggagttcgacctcctgtgggcgaaacaagtcgagttctaccccaaagtgctaacagaagacctccgcagcaaagtgcgcgacgaaatcatcttcttccagcggcccctaaaaagtgcgaaggacctcataggcgattgcgaattggaaccaacagagaagagatgcccgagagcagactggtacgcacgacgcttccgactcctccaagacatcaacaaccttataatacaaaaccccgacggaaccgagcaaaaactcagcccagaccaacgcgccgccctactcggagaattaggccagcgagagaaactcactttcgacaacattcgcgctaaactaggattgctcgagacacaaaagttcaacgcagaataccgaatcggaagaaaaggaaagaaagtcgaggccataaaaggcgacgtcttcgtatggacgatgagaggaaaatcagtcttcggaccaaaagcatgggacgcaatggccgacgaacgaaaagtaagcctgaacgaactgttcgtcgaactcgaagacgacgacctcgcccgaaaactcgaaacagaatacggtctcacggacaaacaagttcaagcagccatgaaagcaagcctgccccagggatacatgtcgttcagtcgcaaagctgtcctaaaactccttccattcatggaagcaggcgccctcacacacgaggcgatagaccaagccggatacagaaaagaagaacccacccaaaccgacgcgatagcgcgagtgtcatttcccccagacctcagaaatcccatcgtccaaaaagccctcttcgaagtaagaaaagtggtaaacgcattagtacgtgagtacggaaaaccaacacgcatcaaaatagaaatggccagagacgtacaaggctccaaacgacaacgagaagaattacactggaggaacgaagacaacagaaagaaaaatgaagaagtcagagacagactcagaaccgatatccacattgacgacccgagtcgagacgacgtaatcaaatacaaactgtggcaagaaagcggcaagatgtgcccatacacaggaagacaaatctgccaagaagccctcttcggaccgaaccccgagttccaagtagaacacatactaccctatgaccgcagcctcgacgactcctacatgaacctaaccctgtgtgaagttcacgaaaacatacatggaaaacgcaaccaaacccccttcgaagcatacgggagcggagcagagcgatacgaacaaattaagcaacgcatcaaagtcctaccctggccaaaacgacaaaaattcctacaacaggaaatcaacctagacagccacataagcagagaactcaacgacaccaggtacatctgccgagagacagtagcatacctcaaacaactcggagtgcacgtacgaggaactcgcggaaagataacagccgaactcagacaccagtggggtctcgacggcatcttctcagagctaggcgtcagacgcgacgacgaccaccgcagacacgccgtggatgccctcgtcgtggccgtaaccgacaacgaacacctacgacggctggcagtcagcaaatacgtgctggccggcccacgtttcgaaacgccgtggtcagcattcagggacgaagcgaggggaaacgtgaaaagaatgaacgtgagccatcgcgtgtgcaggaaggtatccggagccctgcacgaagaaacaaattacggacccaccggagtacgagaccaggcaggccaagacatatacgcatacaggaaaaagctggaagacttaacaactccaatggtagagaaaatagtagacccagtagtccgcgacatcgtacgccaaaggcttcttatgaagggaatagacccagccgcggcagaccgcaaaatcccaaaagacgtatggaaagaaccactatatatgcgccggactaagagcgacaaaatgatccaaatacgacgggtcagaatccacgacgtcaaaaactcgattatagtactaacggacgaaagcgggagaccctacagagccgtagagccgggagggaaccaccatgtcgaagtattcgagtacgtacacggcacaaaaacaggcacacgggaagcggaggtcgtaacaatgttcgaagccgttcgaagatcaagagcccgggcacccgttgtacgccgagaccacggccccggaacccgatttgtgtgcagtctagccataaacgacatggtcatgatgccagacaagagcgggaaaatggacctgtttcgaatacaaaagatgagtgccagcaaacaagtctacttcaggcaccacacagccgcacgaatcgacagcgaacgcacactgatccgaaagcaggcacacctcttcaacgggtacaaggtatcagtcgacccaacaggagctatatgccgagcaaacgactga

SEQ ID NO: 7223 - RNA, 3000 nt, synthetic construct
  misc_feature 1..3000: note = Cas9 variant
  source 1..3000: mol_type = other RNA
atgaaaatccttggcttcgacattggaatcaacagcatcgggtgggccttcgtggaggacaaccagctccaggactgcggggtccgactgttcacaaaagccgaggaccccaagaccaaggagtccctggctctcccgaggcgcaacgcccggagcaaccgccggcgcctcggccggcgtcggtcgcgcctgatcgccctcaagcacatcatcagcaaagggctgaagctgaactaccaagactacatcgccaacgatggcgagctccccaaagcctacgagggccggctgatctctccctacgaactgcgctacaaggcgctcaacgagaagatcgagcccaaggacttggcccgggttatcttgcatatcgccaagcacagagggtacatgaacaagaacgagaaaaagagcagcgacaacgagaaggggaagatcctcagcgcactgaagacgaatgctctaaagctcgagaagtaccagtccgtgggagagtacttctacaaagagttcttccagaagtatcgggaaaacaccaaagacttcatcaacatccgcaacaaggaaggcagctacgagaactgcgtactggcctccgacctggagaaggagctcaagctgatcctggagaagcagaaggagtggggctacagctacaacgacaacttcatcaaggagatcctcaaagtggccttcttccagcggccgctgaaggacttctcctacctggtgggcgcctgcaccttcttcgaggacgagaagagagcctgcaagaacagctactccgcgtgggagttcgtagccctcaccaagatcatcaacgagctcaagagcctggagaaggagtccggcgagctcgtgagctcccaaatcatcaacgaaatcctgaaccacatcctggacaaggggtccatcacgtacaagaaattccgggagtacatcaagctccacgagagcatgaagttcaagtccttaaagtacgacaaagacaacgtggagagcaccaagctgatcgagtttcgcaagctcgtcgagttcaagaaggccctgggcgaacactccctgagccgggaggagctcgaccagatcgccacctacatcaccttaatcaaagacaatgagaagctgaagatcacgctcgagaagtactccctgaacaacgagcagatcaagaaccttctcgagatcgacttcaacgaccacatcaacctgagcttcaaggccctcaacctcatcctgccacttatgaaggaggggaagcgctacgacgaagcatgcaagctgctcaacctgaagaccaagtccaacaaccaaaagttcgacttcttacccgccttttgcgacagcatcttcgcccaagagctaaccaaccccatcgtgaaccgcgccatctccgaataccggaaggtgctgaacgccctgctcaagaaatatggcaagatgcataagatccatatcgagctggcgcgcgacatcggcctgagcaagaagctccgggccaagatcgagaaggagcagaaggagaactacgagaacaacatctgggccctgaacgagtgcgagaagttcgggctgaaggccaatgccaagaacatcctcaagctgaagctgtggaaggagcagaaagagttctgcatatactcgggcaagaagatcagcatcgagcacctccgcgacgagaaggcgctggaggtcgaccacatctacccgtactcccggagcttcgacgactccttcctgaacaaggtgctcgtgttcacaaaggagaatcaggagaagttgaacaagacgcccttcgaggccttcggggccaacgaggaacgctggagcaagatccaggccctggcacagaacctcccctacaagaagaagaacaagatcctggacgaggccttcaagggcaagcagcagcaggacttcatctcccggaacctgaacgatacccgctacatctcaaccctaatcgtcaagtacaccaaggagtacctggacttcctgcccctcgacgagaaggaggacgtgaacctgaagtcgggggagaagggcagcaagatccacgtgcagacgatcaacggcatgctgaccagcgtcctccggcacacttgggggtttgcccagaaggaccgcaacaaccacctccaccatgctctggacgccaccatcgtggcatactctacgaacgcaatcatcaaggccttcagcgacttcaagaaggagcaggagctgctgaaggccaagctgtacgccaaggagctcacttccgacagctacaagcatcaagcgaagttcttcgagccgttcgagggctttcgggagcagatcctgaaccaaatcaacaagctgtttgtttccaagccgccccgcaagcgggctcgcggggccctccacaaggagaccttctactctaaggacgagatgatcaagaagtacaactcccaggagggcgtcgagatcgccctgaactgcgggaagatccggaagatcggcaccaagtacgtggaaaacgacacaatggtgcgcatagacatcttcaagaagcagaacaagttctacgccatccctatctacaccatggatttcgccctgggcgtcctccccaacaagatcgtgatcatcgggaaggacaagaagggcaaccccaaacaatggcaggagatcgacgagtcctatgagttctgcttctccctgcacaaggacgacctggtcctcatccagaagaaggacatgcaggaacccgagttcgcctactacaacgggttcgacatctccaactccagcatctgcgtggagaagcacgacaacaagttcgagaacctgaccgacaaccagcggctgctgttcacgaacgccgagggcaacgtgaaggccaagaagatcgggatccagggcctgcgcatcttcgagaagtacatcatcacgcccctgggcgagaagatcaaggccgacttcaagccgcgggaggacatcgccctcaaaacctccaaaaagcacgggctgtga

SEQ ID NO: 7224 - RNA, 3003 nt, synthetic construct
  misc_feature 1..3003: note = Cas9 variant
  source 1..3003: mol_type = other RNA
atgaagatcctgggctttgacatcgggatcaacagcatcggctgggcctttgtggagaacgacgagctcaaggactgcggggtccgcatcttcacaaaggccgagaaccccaagaacaaggagtccctggcgctgccgcggcgcaacgcccggagctcccgccggcgcctcaagcggcggaaggcccggctgatcgccatcaagcgcatcctggccaaggagctcaagctgaacttcaaggactacgtggcggccgacggggagctgcccaaggcctacgaggggagcctcgcctccgtgtacgagctgcgatacaaggcgctgacccagaagctcgagacgaaggacctggcccgcgtcatcctgcacatcgccaagcaccggggctacatgaacaagaatgagaagaagtccaacgacgccaagaagggcaagatcctcagcgccctgaagaacaacgcgctgaagctcgagaactaccagagcgttggggagtacttctacaaggagttcttccagaagtacaaggagaacaccaagaacttcatcaagatccgcaacaccaaggacaactacaacaactgcgtgctgtccagcgatctggagaaagagctcaagttcatcctggagaagcagaaggagttcgggtacaagtactccgaggggttcatcaacgagatcctgaaggtcgccttcttccagcggcccctcaaggacttcagccacctggtgggcgcttgtaccttcttcgaggaggagaaccgcgcctgcaagaactcctacagcgcctgggagttcgtggcgctcacgaagatcatcaacgagatcaagtccctcgaaaagatcagcggggagatcgtctcgacccagaccatcaacgaagtactgaacctgattctagacaagggctcaatcacctacaagaagttccggtcctgcatcaacctgcacgagagcatcagcttcaagtccctgaagtacgacaaggagaacgccgagaacgccaagctcatcgacttccgcaagctggtggagttcaagaaggccctgggcgtccacagcctctcccggcaggagctggaccagataagcacgcacgtgaccctgattaaggacaacgtgaagctcaagaccgtcctggagaagtacaacctgtccaacgagcagatcaacaacctcctggagatcgagttcaacgactacatcaacctgagcttcaaggctctcgggatgatcctgcccctgatgcgcgagggcaagaggtacgacgaagcgtgtgagatcaccaacttgaagccgaagacggtggacgagaagaaagacttcctgcccgccttctgcgactccatctttgcccacgagctgagcaaccccgtggtcaaccgcgccatctccgagtaccgcaaggtgctgaacgccctcctgaagaagtacgacaaagtacacaagatccacctggagctcgcgcgggatgtcgggctgagcaagaaggcccgcgagaagatcgagaaggagcagaaggagaaccaggccgtgaacgcctgggcgcttaaggagtgcgagaacatcggcctcaaggcctccgccaagaacatcctgaagctgaagctctggaaggagcagaaggagatctgcatctacagcggcaacaagatctccatcgagcacctgaaggacgaaaaggccctggaggtggaccacatctacccctacagccggtccttcgacgacagcttcatgaacaaggtcctcgtgttcaccaaggagaaccaggagaagctgaacaagaccccgttcgaggccttcggtaagaacatcgagaagtggtccaagatccagaccctggcgcagaacctcccctacaaaaagaagaacaagatcctggacgagaacttcaaggacaagcagcaggaggacttcatcagccgcaacctgaacgacacgcggtacatagccaccctcatcaccaagtacaccaaggagtacctgaacttcctgcccctcaacgagaacgaaaacacgaacctgaagtccggcgagaaggggagcaagatccacgtccagaccgtgaacggcatgctgaccagcgtgctccgccacacctgggggttcgacaagaaggaccggaacaaccacctccaccacgccctggacgccattatcgtcgcctactccacgaacagcatcatcaaggcgttctccgacttcaagaagaaccaggaactgctgaaggcccgcttctacgccaaggagctgaccagcgacaactacaagcaccaggtgaagttcttcgagcccttcaagggcttccgggagaagatcctctccaagattgacgaaatcttcgtgagcaaaccgccccgcaagcgggcccgcggcgccctgcacaaggagaccttctactccgaggacgagatgatcaagaagtacaacagcaaggaggggctgcagatcgcgctctcctgcggccgggtccgcaagatcgggaccaagtacgtggagaacgacaccatggtgcgtgtcgacatcttcaagaagcagaacaagttctacgccatccccatatacgccatggacttcgccctgggcatcctgccgaacaagatcgtggtggtcgggaaggacaagaacaacaacccgaagcaatggcagaccatcgacgagagctacgagttctgcttctccctctacaagaacgacctgatcatgctgcagaagaaggacatgcaggaggcggagttcgcctactacaacggcttcgacatcagcacctccagcatctgcgtggagaagcacgactccaagttcgagaacctcaccagcaaccaaaagctgctgttctccaacgcgaaggagggcagcgtgaaggtcgagaacctcgggatccagaacctgaagatcttcgagaagtacatcatcacgcccctgggcgacaagatcaaggccgacttccagccccgcgagaacatcagcctcaagacctccaagaagaacgggctgtga

SEQ ID NO: 7225 - RNA, 3003 nt, synthetic construct
  misc_feature 1..3003: note = Cas9 variant
  source 1..3003: mol_type = other RNA
atggccagggcccaacgacgccttataagtaggagagccaaccgtatgaacaaactccgaagactactaaagcaagagaacgtactacaagcaaacgactacgacgaaaaaggcctgattatcggactcccaaaccaagcctgggagttaagagcacaaggactcgaccgaaagctagaacctaaggaatgggcagccgtcctcatcaacctagtcaaacacagaggctacctcagccaacgaaagaacgagagccaaaccgctgacaaagagctaggagcactactgtccggaatgaaccacaaccaccaactcctccaatcgcaaagcaaccaataccgcacgcccgcggaactcgcaatcaaacaattcgccacccaagatggccatatccgcaatcaacgcggcgcctacacccatacgttcaatagactagatctgcagaatgaactaaaccaactcttcgacgctcaaactcgcctcggcaacccccacgtctctgggtcacttaaaaccgccatcaacgacctactcatgaaccagaaagcggccctgtcaggcgacgctatcctagaaatgttaggaagatgcacattcgaaccatcagagtacaaagcagccaagaacacttacagcgcagagagattcgtctggttaggcaaactaaccaacctccgaatccaagacaatggtctagaatcagccctctcgcgagaacaaagggagctcctcctcaacgaaccctacaacaaaactaaactcacataccaacaagtccgcaaacttctccgcctaccagaaaccgcattcttcaaaggcctccgttacggaaaagacaacgccgaatcagcaaccttcatggaaatgaaatcataccacgcaatacgcaagtccctcgaaaacaagagtttaaaatccgaatgggaaaaactgaagacccaacccaaactccttgatttaataggcacagccttcagcatatacaaaactgacgacgaaatcgcaggatgcctcaaaaatcaactaccagaaaacgtcatcatagcccttcaagaacaactcaacttcagcaatttcatggaactctcactgaaagccctagaaaaactactcccactcatggaacaaggactccgctacgacgaagcctgcacccaaatctacggaaatagacacgagaaaatcgcagacaaaacggaaaagttccttccaaatatcccagcagacaagctacgaaacccagtcgtcctcaggaccctcacacaggcgcgcaaagtgatcaatgcaattattcgccgctacggcagccccgccagagtacacatagaaacgggccgtgaagttggcaaatcattttctgaccgcgacaaacttaaaaagcaacaagaggaaaatcaagaacagcggcggcgcgctatagacgaatggaagcagttcttccccaacgccgcgcacgagccaaaagctgtcgacatcctgaagctgagactatatcaactacaacaaggaaaatgcctatactccggcctacccatcgacgtcaggcgtctccccgaaaaaggatacgtcgaaatcgaccatgcgctacccttctcgcgaacgtgggacgacagcttcaacaacaagatactcgtactcgcctccgaaaaccaaaacaaaggaaaccagacaccatacgaatacctgcgaggcgcagacaacagcgagagctggcgactgttcgtcgaaaacgtacaaaactgccagttttcccccaacaagaaacaaaagatcatggccaagcaactcgacgaaaagggcttcctcgaaaggaacctcaacgacacccgatacgtgagccgctttctctgccaattcataagtgaacacctccacctaacaggaaaaggcaagaaacgggtctttgcatcgaatggtcaaatcaccgccctcctgagaggccgctggggcctaagcaaaaacagagaagaaaacgaccgacaccacgcagtcgatgcggtcgttgtagcatgctccaccgtcgccatgcaacagaagatcacgcaattcgtccgctatcaaaagggaaacgtgttcacgggagaacgcatcgacaaggaaaccggcgaggtcatctccatacacttccccaccccctgggaacacttccgagaagaggtaatgatacgcgtcttcgacgataacccgctccgcaccctacccgaaaaactccccaaccgccccgaagcactacatgaatacgtgatgcctctcttcgtatcgcgaatgcccaccaggaaaatgaccggtcagggccacaaagaaaccatcaaaagcgccaagcgcctcgacgagaaaataagcgtactacgcgtgccacttacacaactgaagctcaacgacctagaaaacatggtaaaccgcgaacgcgaacccgcactctacgaggccctgaaagcacgcctcgaacaattcaaaaatgacccagccaaagccttcgccgagcccttcttcaaacaaggcggacaacaagtgaaagccgttcgagtcgaaatcgtccagaaaagcgggatgctcctccggaaaattaacggcgtagcagacaacggctcaatggtccgagtcgacgtcttcgagaaaagcggcaagttctacttagtgcccatatacgcatggcaagtcgccgaaggtatactccccaactacgccgtcgttgcccacaaggacgaatccgactggatcctaatggacgaaagctaccacttcaaattcgcactttacaagaacgacctactggaagtccaaaccaaaaagggcggcataatggggtacttcgcctccctcgaccgagcaacaggcgcaatcaccatacgggagcacgatcgagacaaaaagaaatgcaaagacggagagcaccgatcgatcggagttaaaatggccagctcattcaagaaactccaagtagacgagctaggtaaaaatatccatgaaacacgctcgcgaaaacgtccaaacatcggctga

SEQ ID NO: 7226 - RNA, 3012 nt, synthetic construct
  misc_feature 1..3012: note = Cas9 variant
  source 1..3012: mol_type = other RNA
atgcgcatcctgggcttcgacatcggaatcaacagcatcggctgggccttcgtggagaacgacgagctcaaggactgcggggtccggatcttcaccaaggccgagaaccccaagaacaaggagtccttagcgctgccacgccgcaacgcccggtcttcacgccgccggctcaagcgccggaaggcccgcctgatcgccatcaagcgaatcttagccaaggagctcaagttgaactacaaggactacgtggcggccgacggcgagctgcctaaggcctacgagggtagcctcgcctccgtgtacgagctgcgctacaaggcgctgacccagaacctcgagacaaaggacctggcccgggtcatactgcacatcgccaagcatcgcggctacatgaacaaaaacgagaagaagagtaacgacgccaagaagggcaagatcctcagcgccctgaagaacaacgcgctgaagctcgagaactaccagagcgtaggggagtacttctacaaggagttcttccagaagtacaagaagaacactaagaacttcatcaagataaggaacaccaaggacaactacaacaactgcgtcctgtccagcgacctggagaaggagctcaagctgatccttgagaagcagaaggagttcggatacaactactccgaagacttcatcaacgagatcctcaaggtcgccttcttccaacgccccctgaaggacttcagccacctggtgggggcctgcacattctttgaagaagagaagcgggcctgcaagaactcctacagcgcctgggagttcgtggcgctcacaaagatcatcaacgagataaagtccctggagaagatctctggcgaaattgtccctacccaaaccatcaacgaggtgctgaacctcatcctggataaggggtccatcacctacaagaagttccgcagctgcatcaacctgcacgaatccatcagcttcaagagcctgaagtacgacaaggagaacgccgagaacgccaagctgatcgacttccggaagctggtggagttcaagaaggccctcggcgtgcactccctgtcccgccaggagctggaccaaatctccacgcacatcaccctcatcaaagacaacgtgaagctgaagacggtcctcgagaagtacaacctcagcaacgagcagattaacaacctgctggagatcgagttcaacgactatatcaacctctccttcaaggccctgggcatgatcctgccgctcatgcgggagggaaaacgctacgacgaggcgtgtgagatcgccaacctgaagcccaagactgtcgacgagaagaaggacttcctgccggccttctgcgacagcatcttcgcccacgagctgtccaaccccgtggtgaaccgcgccatcagcgaataccggaaggtcctaaacgcgttactgaagaagtacggcaaggtccacaagatccacctcgaactggcccgcgacgtggggctgtccaagaaggcccgggagaagatagaaaaggagcagaaggagaaccaggccgtcaacgcgtgggccctcaaggagtgcgagaacatcggcctgaaggcaagcgccaagaacatcctgaagctcaagctgtggaaggagcagaaggagatttgcatctattccggcaacaagatcagcatcgagcacctgaaggacgagaaggccctcgaggtggatcacatctacccgtactcccgcagcttcgacgattccttcatcaacaaagtgctggtcttcaccaaggagaaccaggagaagctgaacaagaccccattcgaggcgttcgggaagaacatcgagaagtggtcaaagatccagaccctcgcccaaaacctgccctacaagaagaagaacaagatcctggacgagaacttcaaggacaagcagcaggaggacttcatctcccggaacctcaacgacacccgctacatcgccacgctgatcgccaagtacaccaaggagtacctgaacttcctcctgctgagcgaaaacgaaaacgccaacctcaagtccggcgagaaggggagcaaaatccacgtccaaaccatcagcggcatgttgacctccgtcctgcggcacacgtggggtttcgacaaaaaggaccgcaacaaccacctccaccacgcgctggacgctatcatcgtggcgtactcgaccaactccatcatcaaggcctttagcgacttccggaagaaccaggaactgctcaaagcacgcttctacgcgaaggagctgacttccgacaactacaagcatcaagtgaaattcttcgagcccttcaagagcttccgggagaagatcctgtccaagatcgacgaaatcttcgtcagcaagccgccccgcaagcgagcccgccgggccctccacaaggacacattccacagtgagaacaagataatcgacaaatgcagctacaactcaaaggagggcctgcagatcgccctgagctgcggtcgcgtgcggaaaattgggacgaagtacgtggagaacgacaccatcgtccgagtggacatcttcaagaagcagaacaagttctatgcgatcccaatctacgccatggactttgccctcggcatcctgcccaacaagatcgtgatcaccgggaaggacaagaacaacaacccgaagcagtggcagaccatcgacgagtcctacgagttctgcttcagcctgtacaagaacgatctcatcctgctgcagaagaagaacatgcaggagcccgagttcgcctactacaacgacttctccatcagcacgtccagcatctgcgtcgaaaagcacgacaacaagttcgagaacctcactagcaaccagaaactgctgttctctaacgccaaggagggcagcgtgaaagtggagagtcttgggatccagaacctgaaggtcttcgagaaatacatcatcacgcccctgggcgataagatcaaagcggacttccagccccgggagaacatcagcctcaagacctcaaagaagtacggcctgagatga

SEQ ID NO: 7227 - RNA, 3012 nt, synthetic construct
  misc_feature 1..3012: note = Cas9 variant
  source 1..3012: mol_type = other RNA
atgatcgatgaaagcctaacattcggcatcgacctcggcatcggcagttgcggctgggcagtactcagacgaccatccgcctttggccggaaaggcgtaatcgagggaatgggaagctggtgcttcgacgtacccgagacgagcaaagagaggacacccacaaaccaaatacgaagaagtaaccggttactccgcagagtcataagacgacgacgaaatcgcatggccgcgatccgacgactgctccacgcggcgggcctcctgccgagcaccgacagtgacgcgctaaagcgccccggacacgacccgtgggaactgcgtgcgcgcggcctcgataaaccgctaaaacccgtagagttcgcggtagtactaggccacatagccaagcgcagaggattcaaaagtgccgcgaaacgaaaagcgaccaacatttcaagcgacgacaagaaaatgctcacagctctcgaagcaacccgtgaacgcctcggcagataccgaaccgtaggagaaatgtttgcacgagacccggacttcgcgagccggcgaagaaacagggaaggcaaatacgaccgaaccaccgcccgagacgacctcgaacacgaagtccacgcactattcgcagctcaaagaaggctggggcaagggttcgcgagccccgaactagaagaagcattcaccgccagtgcgttccaccaacgacccatgcaagacagtgaacgcctagtaggcttctgcccatttgaaagaacggagaaaagagcagcaaaactgacccccagcttcgaacggttccggctcctagctcgactcttaaacctacgaataacaacgcccgacggcgagaggccactcactgtagatgaaatcgccctggtgacaagagacctaggaaaaacggccaaactaagcataaaaagagtacggacgctcatagggctcgaagacaaccaaaggttcacaacgattagaccagaggatgaggaccgagacatagttgcacgaaccggaggggcaatgacggggaccgcgacactacgaaaagccttgggggaggccctctggacagacatgcaagaaagacccgaacaactcgacgcaatcgtccaggtattgtcattcttcgaggcaaacgaaacaatcaccgaaaaactgagagaaatcggactcacactcgcagtactagacgtgctactcaccgcactagacgcaggcgtgttcgccaaattcaaaggggcagcacacatatccacaaaggcagcgaggaacctactgcctcacctagagcaaggccgaagatacgatgaagcatgcaccatggcaggatacgaccacgcagcctcgcgactctcgcatcacggccaaatcgtcgccaaaacacaatttaacgccctagtaacagaaataggagagagcatcgccaacccaatagccagaaaagcactgatagaagggctgaaacaaatttgggcgatgagaaaccactggggactcccggggagcatacacgtcgaactcgccagagacgtagggaacagcatagagaagaggagggaaatcgaaaaacacatagagaaaaacacggcattacgcgcgcgagaaagaagggaggtccacgacctcctggatctggaagacgtaaacggggacacattgcttcgctaccgcctatggaaagaacaagggggaaaatgcctatacactggcaaggccatacacatacgacaaatcgcagcaaccgataacagcgtacaagtagaccatatactaccctggagccgtttcggagacgacagtttcaacaataaaacgctatgtctagcaagcgcaaaccaacagaagaagcgcagcaccccctacgaatggctatcgggacaaacaggggacgcctggaacgcattcgtacagcgaatcgaaacaaacaaagagctgcgaggattcaagaaaagaaactacctactgaaaaacgcaaaagaagcagaggagaaattcagaagccgcaacctaaacgatacaagatacgccgcacgacttttcgcagaagcagtcaaactactatacgcattcggcgagcgacaagagaaaggaggcaatcggcgagtattcacaaggccgggggcactcacggcagcactacgacaagcatggggcgtcgaaagcctcaagaaacaagacgggaaacgcatcaacgacgaccggcaccatgcactcgacgcccttacagtagcagcagtggacgaagccgaaatccagagactcacgaaatcgtttcacgaatgggaacaacaaggactaggcagaccacttagacgagtcgagccaccctgggagagcttcagggcagacgttgaggcaacctacccagaagttttcgtggcccgaccagaacgcagacgcgcacgcggtgaaggacacgccgccacaataagacaagtaaaggagcgcgaatgcactcccatcgtgttcgagagaaaagcggtctcaagtctaaaagaagcagacctcgaacggatcaaagacggcgaacgcaacgaagcgatagtagaagccatacgatcatggattgcgaccggccggccagccgacgcaccaccccggagccccagaggagacatcataactaaaatccgactagcaacaaccataaaagccgcagtgccagtacgaggaggcacagccggacgaggagaaatggtaagagctgacgtcttctcgaagccgaaccgtcggggaaaagacgaatggtatttggtcccagtatacccacaccaaataatgaataggaaggcatggccgaaaccaccgatgcgatccatcgtcgcgaacaaggatgaagacgaatggaccgaggtcgggcccgaacatcagttcagattctcgctctatcccagaagcaacatagagattataaggccgagcggggaagtcatagagggatacttcgttggactccaccgaaacacaggagccctcataccgacacccgtgggaccagacagctacgttatcgcctga

SEQ ID NO: 7228 - RNA, 3024 nt, synthetic construct
  misc_feature 1..3024: note = Cas9 variant
  source 1..3024: mol_type = other RNA
atgaaggtgctgggcttcgacatcgggatcaacagcatcgggtgggccttcgtcgagaacaacgagctcaaggactgcggggtgcgcctgttcaccaaggccgagaaccccaagaccaaagagtccctggcgctcccgagacgcaacgcacggagctcccgcgtgcgactgcgccggcgccggagccgcctgctctcccttaagcacatcatcagcaaggagttcggcctgcactacgaggactacatcgccctcgacgggaacctgcccaaggcctacacgggcaagatcgagtccatctacaagctgcggtacgaggccctcagccaggcgatctccaaggaggacctggcccgcgtcatcctgcacattgccaagcacaggggctacatgaacaagaaccagaagaccagccaggactccgagaagggggcaatcctcagcgcgataaaggagaactccaacaagatcaagcattaccagaccgccggcgagtacttctacaaggagctgttcgagaacctgcgcgacgggaccaaggagttcaagaacatccggaacaaggccatgaagaacgagaagacgggcaatatggagagcacctactacaacaccatcctcgcctccgacctggagaaggagctgaagctcatcctggagaagcagcaggcctatcacaactacagcgataccttcatcaaggaggtgctggagatcgcgttctaccagcgccccctcaaggacttctcccacctggtggggagctgcacgttctatgaaaacgagaaacgggcctgcaagaactcctacagcgcctgggagttcatcgccctgggcaagatcatcaacaccctcgaaagcatcaagaaggacaccggcgagatcttctccaacgagatcatcacccagatcctgaaggaggtccttgacaaggggagcctctcctacacgaagctgcgcaagatgatcaacctggacgaaaaggtgaagttcaagggcctcaagtacgacaaggagggggtggagaagaccaacctgatcgagttcaagaagctgaaggagttcaagaaagccctcggcgagcacaacctggagcggaagaccctggatgagatcgcgacccacatcacgctcaccaaggacgagaaccagctgaagaagcagctggagcagtacgccctcagccaaaaccagatcgatgccctggccgagctggacttcaacgaccacatcaacctctccttcaaggccctgtacgagatcctgcctctcatggagaagggcaagcgctacgacgaagcgtgcaacgagctggggctgaaggccaagaccagcaaccagaagtccgagttcctgccggccttctgcgacagcatcttcgcccaagagctcaccaatcccatcgtcaaccgggccatctccgagtaccgcaaggtgctgaaccgcctgctcaagaagtacggcaagatgcacaagatccacatagagctggcgcgggacgcggggctgagcaaggaggcccgcaacaagatcgagaaggagcagaaggagaacaaggatatcaacgacaaggccgagaagacgtgcaaggagttcggactcaaacccaacgcgaagaacatcctgaagatcaagctgtggcgggagcagggggagatctgcgcctactccggcaagaagatcaccatcgacgacctcaaggaggacaaagccctggaggtggaccacatctacccctacagccgctcctatgacgacagctacaacaacaaggtcctggtgttcatcaaggagaaccagctcaagctgaaccagaccccgtacgaggccttcggctccaaccaggagaagtggagcaagatccaggtgctggcccagaagctcccctacaagaagaagaaccggatcctggacgagaacttcaagaacaaggaccagatcgagttcatctcccgcaacctcaacgacacccggtacgcgacgagcctcatcgccaagtacaccaaggagtacctggaatttctgcccttgtccgacgacgaggacatcagcctcaagagcggggagaagggttccaagacccacgtccagaccatgaacgggatgctgacatcggtgctgcgccacgcatggggcttctcccagaaggaccggaacaaccacctccaccacgccctggatgccatcatcatcgcgtacagcaccaactccatcatcaaggccttcagcgacttcaagaagaaccaggagatcctgaaggccaagctgtacgccaagaagctgacctccgaggagtacaagaaccagagcaagttcaccgggttcgagaagtaccgctccaagatcctcgagaagctggacagcatctttgtgtccaagcccccgaacaagaacacgaagggcgcgctgcacgagcagaccttctactcttaccaggacatcctcgaggagtacaagacccaggagggcctgaagcgggcgctggaatgcgggaaggtccggaagatcggcaccaagtacgtggtgaacgaccggatggtccgcctcgacatcttcaagaaggacaacaagttctacgggatcccaatctacacgatggacttcgccctgggcgtgctgcccaacaaggtggtgaccatcgggaccgacaaggacaagatcaagaaggagtggaagaccatcgacgagacatacgagttctgcttctccctctacaagggcgacctggtgctgatccagaagaaagagatgcaggagagcgagtttgcctattacaacggcttcgacatctccagcgcctccatcagcctcgagaagcacgacaacaaattcgagaacctgacggaaaaccagaagctgctgttccccaaggcgaaggagggggatgtggaggtgcggggcatcgggattcagggcctgaaggtgttcaagaagtacatggtcaccccgcttggcgagatccaggagacccgcaccgaggcccgacagaacatccagccccgcaagaagcacgggctccggtga

SEQ ID NO: 7229 - RNA, 3033 nt, synthetic construct
  misc_feature 1..3033: note = Cas9 variant
  source 1..3033: mol_type = other RNA
atgagcgacagcagctatgtcctaggcctcgacctaggcaccaactcaatcggatgggcatgcgttaggctgaacaaggggaagccagatggactcctagcgcagggcgtcagaatctttgaagccggactggaaattgacgcctacgggcgcggaaccccattgaacacagaacgccgcaacgcacgccaaaggagacgtctgcacgaccgaagaaaaagacgaatactgaaggtgcggcggatcctgcaagaagctggcatgctcccagcaaacaaaccggaccacaaagacgcagaatggaagatgctactggcacgcaacccctaccgcttaagagccaaagccctagacgaacaaatagacctaaaagaaataggcctctgcatataccaattcgcacaccgaagaggatttctaagcaactcgaaaatcctcaagaaagacgacgacagaggaaaattaaaagacgccacaaaggccttcgctgaagacatggaacaaaaaggcgcccgaacctggggcgaatatctaagtcacctcgacccacacgaacagcggatacgcacgaactacacacttagagaatggtacacctccgagttcgacctgatctgggaaaaacaacaatccttctacccacacgtcctcacggacgacctatacaagagagtgaaagaagcactcttctaccaacgccccctcaagagccaagcccatctgctaggacaatgcgaactagagccagggcggaagagggcaccgttcgccctgctgatggcacaagagttccgcctacttcaaagcctgaaccacctacgcgtcgtaagctccacaggagacgaacggctacttaccgacgaagagagaaagcaagccctggccctcctgcgctcgcgaggaaaccaaaaattcacaaccttgcggaaagtactcaacctgcgaggaaccaaatttaacctcgaacgcggaggcgaaaagacaatccaaggaaacaacaccgcagctgccctcggcaacctcttcggagaagcatgggaccacttctcaagcgaacagaaaaaccaaatagtagaagatcggttaaccattggagataccgatgcattgatccgacgcatgaagaaaacgtggggtttagactcggtaaccgcagaaatgttctcagaaacagaactagaagacggatactgcggattctcccgaaaagcactagagaaactactcccgctacttgagcggggccacgcattaatggaagcagtacaggcagcgtaccccgactaccagaaaaaccttccgcgcacagacacgctgccgcccctggagaacctcagaaacccaatcgtgcaacggacgctctccgagctccgacgagtggtcaacgcgataataaaagaatacggcaaaagtgacaaaataagaatagaactggcacgggatatgaaacaaacagccaaaaacagagaaaaatcctgggaccgcatgcgcgtaagagaaaggcaacgcaaggaagcagcaaagaaaatcctcgaggaaacaggcaacccggcaccacgacgccacgaaatcgaaaaagttctacttgcggaagaatgcaactgggaatgcccgtacacagggaagcgcatatgcatgaacacccttttaggcgacgcaccccaattcgatatcgagcacatcatacccttcagccgcagcttcgacaacagtttctccaataaaacgctgtgcgacgtcaactacaaccgaaacgtaaagggcaacaagacaccctacgaatccgccagcgaaaccgaacacgaagaaatggtctgccgagtaaaacgcttcacaggcgactacaaagaaataaaattggacagattcaacacccgagagaccgactcacgagccgacttcatagaagaatttagcacaagccaattaaacgacacgcgatatgcatcccgcctagcaggagagtacctcgggaaactctatggatccgaatggcgtaagcacatccaaatagcaaaaggcggaacgacgaagtacctcagggacgcctgggatctaaaccgaatactgagcgacggtggaaccaaatcaagagacgaccaccggcatcacgccgtggacgccgtcgtcgtggccctcacaacaccacaaacggtcaaggccctgagcgatgccaaccaacgagccccagaacaccgaagatacgcgttctccgatatgccattaccatgggaaactttcagacaagacgtagaacaggcaatcaacagcatcacggtaagtcacaaggtctgcagaaaggcaaacggacagctccataaagaaacattctacggcctcataaaggacagaaaaacaggcgacactaggacagtattaagaaagccgcttcacgaactgacagacaaggagataaagcgcgccgaaatcgtcgactcaagcataagaaagctgattgaacaaaagctcaaagacctggaccaacccccaaaaacagcattcaaggaccgtaacaaccaccccttcataatcgacaagaacggaaacaaacgcttcatacacaaagtaagagtataccaggatgcgaagccagtcaaaatagcagaaaacagacatgttaaacttggagggaaccatcacctagaaatattcgaggtcattgacaagaaagggaatcccacatggaaatgcgaggtaattagcctcttcgacactcgacaacgcgtgaaagaaaaacgccccgtcatagtccggcaagaccagaacggcaacccactaaaattctcactgtctatcggagaagccgtacagctagactggaacggcgggagagagacagcagtggttcagaaaatgagcaaaaccccaaacacggtagaatacgtcttcagaaaacataacgacgcaaggaaagcagcagacatcccatacaaggaaacaataacagttaagtcggactcagcactcttcgcatccaacctccagaaaatcgtaatcacccccacagggctcattagacgcgccaacgactga

SEQ ID NO: 7230 - RNA, 3033 nt, synthetic construct
  misc_feature 1..3033: note = Cas9 variant
  source 1..3033: mol_type = other RNA
atgaaaaaccgcaacgtaataggtatcgacgtcgggacaaactcgataggatgggcgctagtcgaggaaaacgaaaacggacttccgcaatccctaaaagcagccggcgtccgcatcttccaagaagccgtcgaagccaaaacacgcacccccaaaaaccacaaacgccgacaagcacgactagcacgccgagtcctcgcccgcagagcgagacgcaagcaaaggctccaaaaccttctccttaaacacggactattgcccggcggagtcacggaccccgtccaaagagaggccgcattcactacactcggggacccctaccaactacgagccaaagggctaaacctcccactaggacttcacgaatttggacgcgtactattccaactcggagcccgacgaggattcctctccaatagaaagacacgatacggacacctgaacaagctagacgaactcgctgatcttatagaggcggaagacgcagcgccaaaaactggcgatgcagaagaagggatcataagaaaagaaataggcgaactacgccaagcaatgagcgcggccggttcccgaacactcggagaatacctagccggccttgcaaaggaagaacggaaacgatgcagacacacagagagggccatgctagaagaagaatttgaaagactatggatggtccaggcccgattccacccagaactctccgacgaactaaaagtgcaggtacacaccgtgatattcttccaacgaccacttaagtcgaatagagcgtcactcggcaaatgctcactggaaccctccagaagaaaggcagcccgagcgtggccagaagcccaacgcttccgcctactccaagacctaaacaacctagaaatacttgacccgcggacaggagaactccgccgactacgcgatacagaacgcgcaatactgctgaatgcccttgagcaacagaaatccatgacctggaacgccgtacgcaagaaactcgggctgcaccaaggggaaaaattcaacctagaaaccggcgccaaggcagagacaggactcaaaggactccaaaccctcgcgagcctccacgcgattctccaaggatggttcgacgaactaggggacaaaagagatctactcatcgaagacctcatcactatagaagactcagcaggtctctaccgacgcctaagggagcactgggggttcgacagagagaccgcattccgactagcaacactcgagctcgaaccgggctacgcatcactctcccttaaagcaatacgcaaactcctgccacacatgggcgccggacaccgttacagcgaagcccgacaacaggtgggctacggatacgaaacagggcagagagacctccaggagagactcggcgagccacccgacccccgcaaccccgtagtcgacaaagccctacacgaacttagacgcgttatcaatgccctgattcaccgattcggccgacccgacgtagtgagagtcgaactcgcacgtgacctaaaactagcgaagcgagacaaggagcgccttgaaaaacaaaacagggaaaaccaacgactcaaccgaaaagcagaggcagctttagccgaactcggactcggtcagccaagcagggacgaccttatcaaatatcgactgtgggaagaatcaaaaggcttatgtccctataccggccgcgagatcggcctaagcacactgttttccccagaagtcgacgtcgaacacatcatcccatactcacgctgcctcgacgactcgtacatgaacaaaaccctatgcatgaccgaagaaaaccgcatgcaaaaaggcaatcgcacaccctgggaagcatatggaggagatccagcacgatatgaacagatactacaatgcgctcgctacttccccatggccaagcgaaagagattcttggaacaaggctcagacttcgtcgaccaattcatacaacggcagctaaacgacacccgatacatcgcaaaactagccaaggagtacctagccgccgtgtgcaccaacgtccaagttaccaaaggaggtaccaccgcgatgctacggcaccattggggcctgaaccggttactgggagaagacgacggccaaaaagaacgaggtgaccacagacaccacgccctggacgcagcggtaatcgccgttacctcacgcagcctataccaaagactagcccgcatcgcccaccagcgcgggcacgcgccgtcacaacgcggtttctacatcgatcccccgtggcagggataccaagcagacttggcccaaaccctcgcaggaatcgtcgtgagccatgcaacaaaccggaaactaacaggagcactccacgaagaaaccgcatacggccacatcccacacgtcggattcgtctaccgaaaaaccctaaacaaagactttaaactaggagacatagaagccatctacgacccctccctacaagagctagtaaaagcccacctggaacaccacggaaacgaccctaagcgcgccttcgcagagggcatccagtgctaccacaaagacggccacacacccataaaaagggtacgcatcagagcgaaacaggtatcagaaaaaggaaccttcagcataagcgaccgggcgggtcgcgcctacaaacatcacaaaaccgggtccaaccaccacgtcgaaatattacgccaccgcgccacaggcaaaatcgaaccagtctacctcaccaccaaggaagccaccgagcgagccagaagaggaggagaaccagtcatacaaagagaccacggcccagaatgggagttcataattagcttatgcataaacgatatggtgcgactgggcgaaggaggacaagtcgcatacttccgagtccagaaaatagaagctacaaacaaccgtgtcacacttcgatcccacctcgcagcaacacttgacgacgaagacatgaaggtaaccacgtccgtcccaaagctagcagtaatgccagggttccaaaaagtcctcgtaaccgccgtcggggaagtcctcgaactccacgattga

SEQ ID NO: 7231 - RNA, 3033 nt, synthetic construct
  misc_feature 1..3033: note = Cas9 variant
  source 1..3033: mol_type = other RNA
atgaaaagaatggcagcagtaggcctcatgccggcagaccccacagaagcgaaagcacttgaactattagatccctacgccctccgcgccgccggccttgatcaagcattacccctcacacactttgggcgagcgctgttccaccttaaccaacgacggggcttcaaatcgaacagaaaaacagacaaaggtgacaacgaatcaggcaaaataaaagacgcaacaaaacgtttagacgaggaaatggctatcaaaaacgcacgcacatacggcgagttcctacacatgcgaagaacatcggcaacagatccgaaaaacgtcccaaccgtccgcacgagactatcaatcgcacggagagacaacgccgaaaaagaagaagcggggtacgacttttaccccgacaggcggcacttagcggaagagttcgataaactctggaaagcccaggccggctactcacccgatgtgttaaccgacgaactgcgggacgaaatatcagtaatcatattccaccaacggcccctgaaaacacctgaagtaggactctgcctattcagcggatctcacggggtgccaaagaaagacaaaaggatcccgtccgcccacccgctcaaccaacgaagaatattattcgaaactattaacaacctcagagtagccgcgcgcggcgaaccggccagaggactcacacgtgacgaacgcgacgccatagtacacgcgctcgacaacaaagcccacaccaaatctctgtcaggcatgagcatgaagctaaaagcgctcggaaaggtaataaagttacgaccagagcagtcattcacgctccaaacagcgaaccgagaaaccatagcatgcgacccagtacgcgcaagcctctcccacccagatagattcgggccccgctggagcatgttagacgcagacgcccaatgggacgtagtacaacgcatcagagccgtacagagtgaagcagaacatgacgcactcgtcaaatggctcatggccacacacggactcgacagagaccatgccgaatccaccgccaaggcacccctccccgaaggctacggcagactcggactcacagccaccaaacgcatcttggccgcactcgaggctgacgtaataccatactccgacgccgtcaaagcatgcggatggcaccatagtgacggacgtacaggcgaagtcctgacagagctcccatactacggacaaatcctagacagacacgtaatccccggaacgtacaatgaatcagacgacgacgtcacccgctacggacgcataaccaaccctacagtccacataggactcaaccagctccgccgactggtaaacaagatcatcaccgtatacggcaaacccgacgagatcgtagtcgagctcgcccgagacctcaaactcagcgaagaccaaaaacgagatgtccagcgcgacatcaagaaaaacacagatgctgcaatcgcacgaggagcaaaactctccgaaatgggcgtccccgatacaggtgccaaccgtatggtcttacgtctatgggagtcgctaggcgatgacgtcatgacacggaactgcccatattcaggcaaacgcatcagcgccaccatgctattcgacggatcatgcgacgtagaccacatcctcccctacagccgaacactcgatgacggattcgccaaccggacgctatgcctaaaagagttcaaccgccagaaaaccgacaaaaccccgtgggaggcttggggagacacacccgcgtgggccactatcgaagcaaatctcaagaatctacccgccaacaaagcctggagatttgcacccgacgccatggaacgattcgaaggcgaaaacgacttcacctctagggccctaaaagacgcccaatacctaagccgaatagcccgaacttatctcgacgccctctacgacggggccgacgggaaaagccacgtctgggtcgtacccgggagactaaccgaaatgctacgccgacactggggactcaacagcctcctcccagacaaagacggagccgtgaaagccaagaaccgaacagaccaccgacaccacgcaatagacgccgcagtggtcgcagccaccgaccgaagcctaattcaacgcatcagcaaaatggcgcgcaaagacgaagtcaatggcgcagaagaagttgcgcggtcagtaccccctccatgggaaggcttccgaacagacatagagacgcaactagacagaatcatcataagccacagggcagaccacggaagaatcgaccccgccgcgcgaaaagacgggcacgacagcacttcaggacaactgcataacgacacagcatacggactaggagagggaaacagtgtggtatcccgaaaacccctgctatccctaaaatcgaacgacatagaagtaacgacaaaaggcgccaacataagggatgtggacctccagcgacacctcgagcgcatcacaagaggcctcgacggcaaggcattagaagcagccctagctgagttcgcggccacggcgaaactacccgacggaacggacaacccgtactacgggctacgaagagtacggcttgaagaaaccctacaacaaggcgcaagagtcgaagtaaaggaccgaaacggaaaaccattcaaggcatacaaaggcgactcaaaccactgctacgaaatctggcgaatgcccgacggcaaagtagtcccccaagtaataaccacctacgaagcccatcaaatcgacgtagagaagaaaccacacccagcggcaaaacgactcctacgcatatttaaaagggacatggtagctatcgaacaagacgacaaagcaattattggatacgtacaatcaatgcacgtcgccaacggcctattcatcgcccctcacacggaggccaacgctgacgcacgcagtagggacaaaagcgacagcttccgcttaatacaaatgagcgctgggccactcgtaaaagccaacgcgcgcagggtctacgtagacgaaatgggccgattacgcgaccccggagccccctcctga

SEQ ID NO: 7232 - RNA, 3039 nt, synthetic construct
  misc_feature 1..3039: note = Cas9 variant
  source 1..3039: mol_type = other RNA
atggcaaacatgcgctaccgactcgcactcgaccttggctcaacttcgctcggctgggcaatggtccgactagacgcccaaaacgaaacctgcgcggtgatcaaagccggcgtgcgcatattctctgacgggcgcaatcccaaagacggctcgtcactcgcagtctcccgacgagaggcacgggcgatgcggagaagacgagaccgcctcctcaaacgcaagacccgtatgatggcaaccctgatgaaacacgggttcttcccacaggacgaagcagcgcgccaagccctagtaaacaaggaacccttcgccctcagagcgaagggattagatcacgcactactaccagaggagttcgccagagcactatttcacatcaaccaaagacgcggcttcaaatccaacagaaaaacggacaaaaaggaaaccgacagcagcgcactgaagaaagccataggccaactcagagaagcgatgcaagcatcggggtgccgcacagtcggagaatggctctgcgcacgacatcaacagggactaagcgtaagggcacgctatcgcgagaaccgaataacaaaagacgatggaaaaacaaaaatcgagaagtcatacgacctgtacatcgacagagccatgatcgaagcagaatttgatgccctttgggcgaaacagtcagaactcaaccccgaattattccacgaaaccgcccgtgccgaactcaaagactgcctcctccaccaaaggcctctaaaacccgtcaaaccaggcagatgcaccctactcccagacgaggaacgcgcgcccctagccttacccagccaacaacgcttccgcatctaccaggaagtaaacaacctccgactgctccgcgaaggcctgaacgaagaaccactgacactaacacagagagaccaactcatacaagccctcgagaccaacccgaaacgatctttcacacaaatccaaaaactcctcggcttcagcggccaattcaacctccaggacgacaaacgcacagagcttaaaggtaatagcacaagcgccatgcttagcaaaaaggaatttttcgggagtcaatggctcagcttcgacgaaacgcaccaagacgagatcgtgatgcagctagtatccgaagaaaacgaagcacgactaatcgcatggctccaagcagaaaccggagtcgacgaaataaccgcggaaagaatcgccaatacacccttagccgagggctacggctccctaagcgcaaaggccctcgaaaagatcttaccagcactacgagccgacgtaatcacctacgacaaagcagtactagccgcaggcttcgaccaccattcacacatctcgcacgcggccacgggagaaatactgccagacttaccatactacggccaatacctccaacgacacgtcggattcggcacgggaaagcccgaagacccggccgagaaacgatacggcaaaatcgccaaccccacagtacacatcggactcaaccaagtcagaacagtcgtaaacgcactaataaaaagatacggacacccgagcgaagtcgtcgtagaattagcccgagacctcaaacaatcacaagagcaacgcaaggaggaacaggcccagcaagcgaaaaaccaacgacgcaacgagagaatgaggcaagacattgccggactcctaaatacatcaacagaacgagtccgcgccctcgatctgcaaaagatgatactatgggaagaactgagcttcaacgtcgcggatcgacggtgcccatacagcggggtacaaatctccgcccaaatgctatttagcgaccaagttgaaatcgaacacatcttacccttctcccaaacactagacgactccctaaacaacaaaaccgtagccatgaggcaggcaaatcgaatcaaaggaaaccgaacgccagcggaagctgcagccgactttgccgcgcaaggatggccggtagaggacatgctccacagagcatccctcatgccgaaaggaaaacgataccggtttgcacaagacggaatggcacagtggctccgagaggacaaaggattcctcgcgcgcgcgttgaacgacacgcgacatctatcacgagtcgcgcgtgaatacctatcacttgtatgcccacaaggaacccgagtaatacccggtcgtatgacagcaatgctgcgagctaaattcggattaaacgacatactgggactgaacggggagaaaaaccggaatgaccacagacaccacgctgtcgacgcatgcgtcatagccgtcacggaccaatccatgctacaaaaattcgcaaaagcctccgcatcagccagagaaaaacaactaaacaaactcgtcgaaagcatgcccctcccgtgggacagctaccgcgaccatgtccaacgcgccgtagaaagaatctgggtatcacacaaacccgaccacggtcacgaaggcgccatgcacaacgacacagcatacggactcctgggaggaggacacgtccaagtcagaaagagaatggacggtgtaagaacgagagaaacagcggcgctgaaagtgatagagttcgccgaccgccaagcacacccacgacacggcctcctaccaaacggagaacccatgccctacaaaggctacaagggcgactccaactactgcatggaaatcgttagaaacgacaagggcaaatgggaaggcgaagtcgtctcgaccttcgaagcataccaactcgtccgccaacacgggctagctagactgcgacatccagccctatcggtaagcgggcggccccttgtaatgagactactcagaaacgacaccttgcgcgtaatccacaatggggagcaacgcacggtccggatatgcaagatgacggcggaaggcgtcatagccctcgcggacacgactgaatcaaacgtcgacgcccgaacacggacgaaggacctatcatacatcttcaaaacagccggatcactccaaaagtcaaaaggacgacgcgtcgcgatctccccgagcggcgaaatgaaagaccccggattcttcgattga

SEQ ID NO: 7233 - RNA, 3051 nt, synthetic construct
  misc_feature 1..3051: note = Cas9 variant
  source 1..3051: mol_type = other RNA
atggaagttttcgtcgacgtctcagcacgccagctaggcatcgacctaggaataggaacatgcgggtgggcgctgctagctgaagactcactaatagcactaggaacgcgaacattcgacgtgccagaaaccgataaagaaagaatcccgacaaaccaaatcagaaggcaagcccgtggcatgcgcagagtaatagacagacgacgccaaagaatgaacgcggtgaggaggctactggcagaccacggcctgctagccgacggcggaaaactaggtctagcgaccgtgcgcctagacccctggcaggcccgagctgaaggcctagacagactactttcagccggagaactcgcagtggcgctaggccacatcgccaaacaccgcggattccgctcaaactccaaaagagacagaggcgccaacgcgcccaaagaatcatcagccatgctcggcgccatagcacaaacaggagagcgactccaacattggcgcacggtaggagagatgttctggaaagacgagttctaccaaaccaggaggagaaaccgcgacggagactactcacgcaccgtccaaaggctagacctcgaaacggaagtccacaggctccttgcagcccaacgacggctcggcaacccactcgccaccttcgacctagaacaatccttcatagacgtcgcgttcttccagaggccactggccgactcagacgacaaagtaggaccttgcccgttcgagccctccgagaaaagagcagcacgacatagccccagcttcgaaaggttcagactgctcagccgactagcggccttacgactcagtagcggcgccggcgaacggccactaagcgatgcagagttcgctgcagcctgcgcagactttggacgactccagggtttcagcttcaaaagactccggcaacacttaaaactcgacccatcaatcagattcgccggaatcgcgcccgacgaagaaggtaaaagggacgtggtggcacgaagcggcgaagccaccccaggaagcgcagccctacgacactgcctaggagacacggtgtgggataacatgctcgggaccagacccgcactactggacgcgatcgcagccatactcacgttcagagacgacgccgacagaatagccgaaggcctggcaggactgggaatagaagaacccatactagacgccctcatggatggagtaaggaacggaagtttcggcaaattcaaaggaccaggacacatctcagctaaagcctgtagagccctcctgccacacttggcaagaggacgcgtatacagcgatgcatgtgccgacgcgggctacgaccactcccgccaaaccgagactaacctagacgacatcaggaacccagtcgccagaaaggccctaggtgaggcattgaagcaaataaaaatcataatacatacacacggaagaccgactgcaatacacgtagaaatggccagagacatcgggaagagtgcagacgaaagagatgaaatcaagaaaggcatcgacaaaagaaactcagaaaaagatagagcccggcaacaattccacgaaatggtgggaactcccgccgccggagcagaagacctactaaggttcgaactatggaaagaacaaaacggatggtgcctgtacacaggaagagaaatacccatcgacgcgctagtatcctccgacaacagaatccaagtcgaccacatccttccctggtcgcgaagcggcgacgactcctacataaacaaaacgctctgctttacggaagcaaaccaacacaagaaaggaatgacaccatgggaatggctacacgatgaccccgaacgatgggaaaaattcgcaagaacagtcgaaggatgcaaaacgatgaaaggcaggaaaaagcgcaatctacttctccgggactcaagcagactggagaaagagttccgaagtcgaaacctcaacgacacacggtacgcatgcaggttactattagggattctcaaacacacatatccagacatagtcgtagccgcaagacccggccccttgacggaccgactgcgccgagcctggggactgcaaagtctaaagaaacacgaagacggaacacgaaaagacgacgatagacaccacgcactagatgcagcagtagtcgcagcaaccagccaatccatgctccaacgcttgaccacactattccaaaaagccgaacgggaaggaggccggcgagacttcgtaggactagaacccccgtggccgggatttcgcgcagacctagaagccaagctcgagggcgtcgtggttagccgcgcggaacggagacgagccaggggcgcaggccataaagacacaatccgcgccattggagaaggagacgctggtcccgtcgtgtacgagcgcaagcccgtagcagcactcacagaaaaagatctggatcgagtaaaggaccccgagagaaataaggtcttaattgaaaacctccgccagtggatagcagcaggaaaaccaaaagacccggacaaggcaccccgatccccaaaaggcgaccccatgacaaaagtaaagctagtcaccacagacgatgtaagaatcctagtccggggcggaacagcagaccgcggcgacatggcacgggtggacgtcttccgacaggcggacccgaaaggacgctggcgattcttcctcgtcccggtatatccccaccaagtattcgacccaacagactggccacaacccccaaaccgcgctgtagtcgcatacaaacccgagaaagaatggacagtaatgggacccgaccacgagtttctctggagcctctaccccttctcgtggatcgccgtagaaaaagccgacggcacgagaatagagggatacttccgaggcatgcaccggtcaaccggagccataagcataagcccacaccacagcaaaagcctagcctccacgggcataggcgccaaaacactggcctcgttcaggaaattcgcaatggacagaatgggcaacctaagcgaaatcgaaagagaagtaaggacctggcatggagtagcctgcacgtga

SEQ ID NO: 7234 - RNA, 3054 nt, synthetic construct
  misc_feature 1..3054: note = Cas9 variant
  source 1..3054: mol_type = other RNA
atgcgtgttgactccctagggcgatgcctctccgacgaagagtgggcgcgcgtcatctaccacctatgcaagcaccgcggctttcactggatctcccgcgccgaagccaaacaaaccgagggcgactcaaaaagcgaaggaggcaaggtaaaacaggggctagccgggaccgcaaaactaatggacgaaaaaggttatcgcagcgcggctgaaatggtattggccgaatttccggaagcccaacggaacaaacaaggagaatacagaaaagcactcagccgagagctgctagccaaagaactcgcactactcttcgcacggcaacgcgtcttcggcaacagacacgccacggacaccctcgaaaccgcaatactcggaaactcagacaagaaatccggcctattttggcaacaaaaaccggctctcgctggcgcagacctactcaagatgctaggcacttgcaccttcgagaaaaacgaatatcgggccccaaaggcatcattcaccgccgaacgacacgtatggcttacccgacttaataacttgagaatcgtcacggatggaattacacgacaactcaccgaacaagaacgccagcttgtcctaccgctaccatacagacaagcaggcgatctcacctacaaacaactcggtatggcactcaccaaagcaggcctcctcgaggccggctgcttcaaattcatcggccttgcctacccaaccgaagctcaaaaagcagaaggcaagaccaaagaccccgaatcagcaacactcgtcaaaatcccagcctggcaagagttacggcaaactctcaacaaagcatctctaaacgacgagtgggagaaactgtcgggagacgccctgtgcggccaacccgaaatctttgacaagatcgcatggatcctatccgtctacaaagacgacgacgaagtaagaaccgaactagccaaattagtgctcccaaacccggagggcctcaccgaagcgcttctcaacatccgcttcgataaattccatgctctaagcctcaaagcactacgcgccatcgtcccccacatggaaaaagggctacgctacgacgaagcctgcgtgcaagccggctatcaccactcccagctacacaagatcggtgaaggagaacacaaatatctacccccactctacgacggccgagacggcgacggacgtatgatattcgctgaagacgccgacattccgcgaaacccagtcgtactcagatcactcaaccaagcgcgcaaagttgttaacgccatcatccggcgatacggctccccgagcgcagtgcacatcgaaatggcccgcgacttgtcacgacccttcgacgaacgaaataaaatcaagaaagaccaggacgagtaccaagcgcgcaatcaaagggaccgcgaacaattcatagaactcttcggtcatccccctaaaggcctagagttcgaaaaatggagactgtaccgggaacaaaacggccaatgcgcctacagccaaaaaccgctcgcctcatccggggacgtcgccgaaatcttcctagacggctcgactgaaatcgaccacgcactcccctattcacgcagcttcgacgactccaaaaacaacaaagtcctagtgctaaccagagaaaaccgagataaaggaaatcgcactccttacgaatacctagggggagcagaaaactccgagagatggcaacggttcttctccttcgtcgaaagcaacaaagcctaccgactcgcaaaacgcacccgactgcttcgcaaagacttcggggccaaagaaagcgaagagttcagagaacgcaacctcaacgacactaggtacgtatgccggttctttaagaactacgttgaacaacacctaaaattagcagaaggttcagaggcaaaaagatgtgtggttgtgtccggccaactcacgaacttcctacgcacacgctggggcctactaaaaatacgcagcgactcggaccgccaccacgcactcgacgccgcagtcgtagcagcgtgctcgcactccatggtacaacgcttaagcaactactcgagaacccgcgaactcgaacaagtccgagacggtttcgttaacattgaaaccggcgaaatagtaaaccccgcgatgcaccaacagttgcgagaacacttccccgacccatggccctacttcaggcacgaactagaagcccgattaaagatcgactcccctgcactcctacgagaagaaatggcaagactttcatcatacacagaagaagaattagccgcgctgaagcccctcttcgtaagccgggcgccgcaaagaagaaacgggggcgcagcacataaagacactatctacggacaaccagaaaaacttaaaaagaacggttccgtctcacaaaaagtcgcactcgccagtctcgccctaaaagacatagacctactagcagacccgcacaggaacgcgaaactgtacggcgccatccgtgaaagactagaagcccacggcggaaaaggagataaagccttccccgcaaccaatccactacgcaagcccgacaaggaaggtaaccccaccggaccaatagtccgaaccgtcaccaaagttatcgacaaactttcaggcatcccagtccgcggcgggatagccaaaaacgacaccatgctaagagtagacgtcttcacgaaagcggggcgcttccacctagtgccagtatacgtccaccaccgcgtcaccggcctccccaaccaagcaataacacgaggtaaagacgaaaaccaatgggctatcatcgacgacaccttcgaatggcgcttttccctctaccctaacgacctagtacaaatacgcctgaaagacgagacccaccttggatattatgcctccaccgaccgctccacaagctccatatccatatgggcacacgaccgaaaccaatccgttggaaaagacggcctgatacgctccatcggcgtcacaacagccaaggacatcgaaaaattccacgtcgacaccctcggaaacgtctacccagccccaccggagaaacgacgcggcctcgcatga

SEQ ID NO: 7235 - RNA, 3066 nt, synthetic construct
  misc_feature 1..3066: note = Cas9 variant
  source 1..3066: mol_type = other RNA
atgaggcgccggagagacagattcaagcaacgacaagccgcgctgctgaaacacctggcaggcgtcggcctattcccagcggacgaagcggcaagaagggagctagcaggactcgacccttacgaactaagagcaagagcgctgcacgaagcactaccacttaaccacataggacgcgcactattccacctaaatcaaaggagaggtttcaaaagcaaccgaaaaacggatagaggaaaagcggacgacgaagggaaaataagactaggagtagccagactccaagaggccatgcatgagaaagggagtgcaactctcggagagttcctgcacggaaggagggcggccgccacagatccaaaccaaataccaagtgtgcgtaccagactgagggcagaatccggggaaggagcacgcggagacggatacgacttctaccccgacagacgaatgctcgaagacgagtttgaagccatctgggaaagtcaacaggtacaccacccggcggtccttacagacgaaatcaaacagagattctttgaggtaatattctaccagcgaccactcaagcaaccggaaatcggcacatgcacgctggtagccggagaacgccggctaccaaaggcacacccactcttccaaaaacgacgactattagaagaactgaacgcgctccggatagtctggcccggagtgcaggccgaactgctatcgcgagaacaaagggacctggcctacctgaagctaaaagacaagcgagcagtaaggttcgagagtctgcggaaagcactgaaattagaccccgacgcccgattcaacaaggaatcagaaaatcgaagcgaactaaaaggcgacgaagtcgcagcagaactcggagccaagagcagattcggaggcagatggggccatacggcgccggcagaccaatgggagatcgtatccagaatacaagcgctagaaagcgacgatgacgaggcacaattctgcgtctggctaagcgaaagatacggactagactcggagcaggcaagagcagtagcggcagcacggctaccacagggattcggaagatttggactaaccgcaacgaccagactgataaaagcactccaagatgaagtaatagtatactcggaggccgtccagaaaacaggcctaggacaccacagcgactttcggaacggagaagtattggcagagcttccatactacggcatagcactggagagacatataatgccgggaacgggagatccaggcgacagcgacgaaatgcgtgtagggcgcgtgacgaatcccacagtgcacataggcctaaatcaactacgcagagtggtaaacagactcatcaaacgatacgggccaccgagacagatcgcggtagaactcgcacgagaactcaaactggatgaccagcacaagcgcgagataaacggacgaaaccggcaaaaccgggaagcagcagaacgaagatcccagaagctagtggacataggaatcgcggacaaaggagcgaaccgcgcactcttaaaattgtgggaggagcttaacccagacaacgccctagaccgacgatgcgtatacacgggaaggcaaatctcgatagagatgttattcagcggagcggtagaagtagatcacatcttaccattcgccgcaacactagatgacagcaacgcaaacaaactactctgcctacgcgaagcaaacagaaacaaaagaagaagaagcccgtttgaagcattcggacaaggggcagactgggaagagatcgccgcacgggcagcacgcctaccaagagagaaaaggtggcgattcgaacccgacgcgatggccaggttcgacacagaagagaaattcctcgcaagacagctggtcgacacacagtatctatcaaggctggcaagagaatacctaggagtactatttccagataagggcgaagggagcggaagggtatgggtaagcccgggaagactaacagaaatgttaagaagaagttggggactcaaccacctcctcccagaccacaacctcgggggcggcgcagaccaacccaagaatcgacgcgaccaccgacatcatgcgatagacgcaatcgtagtcgcggtaaccgacagacacctactacaagccatagcaagagaagcagggcagagggggcacgaagcggccaaccgaatgacagcagacctcccggtaccatggcccgacttcgaccgagacgtgggccaagtcatcagacaggtagtagtgagtcacagagcggaccacggcacggtatcaaaagcgggagcggcaaaaggccaggactcaacggcgggacgcctacataacgacacggcatacgggctcacggggcaaacagacgaaaagggaaacacaatagtagtcaggcgggtaccgctgacggcacttaagaaaccgacgagcatagaagccgtcagagacgacgaactaagaaaagcactatcagtatggacaagggggtatgatggcaaagcgttcgaggcccgcttaagtagattcccagaactaggacccctacaattcaggggaatacgacgtgtcagagtagtggaaccactcactgtaataccaataagagacagcagcgggagagtatataaaggatataagggagacagcaattacagatatgacgtttgggaactcaaagacgggaagtgggtggccgaagtagtgagtatgttcgacgcgcatcagagcagttggacaagtccggtaagacgggaaaatccaacggcccgaaaagtactcagcctacagcagaacgacatagtcgcaatagagccggaagggaaagaaagggagctaatgagagtcgcacagctccgacaaggagggcaaataacactggcagcatgccacgaagcaggggacctcaagcggagagacgcagaaagcaacgaggtagaccctttcaaatatttctcgcccaccgcgggcggtctgaaaagagtgagggcaaggcaagtcagagtagacgaactcgggagggtactggatccagggtccagagacagagagcgcggggcggcatga

SEQ ID NO: 7236 - RNA, 3066 nt, synthetic construct
  misc_feature 1..3066: note = Cas9 variant
  source 1..3066: mol_type = other RNA
atgaagtacaccctgggcctcgacgtggggatcgccagcgtcgggtgggccgtgatcgacaaggacaacaacaagatcattgacctgggggtgcgctgcttcgacaaggcggaggagtccaagaccggcgagagcctggccacggcccggcgcatcgcccgggggatgcgccggcgcatctcccggcgcagccagcggctccgcctggtcaagaagctgttcgtgcaatacgagatcatcaaagactccagcgagtttaaccggatcttcgacacctcccgcgacggctggaaggacccctgggagctccggtacaacgccctgagccgcattttgaagccgtacgagttggtgcaggtcctgacccacatcaccaagcggcgcggcttcaagtccaaccggaaggaggacctgagcacgaccaaggagggggtggtgatcacctccatcaagaacaacagcgagatgctccgcaccaagaactaccggacgatcggcgagatgatcttcatggagacccccgagaactccaataagcgcaacaaggtggacgagtacatccacaccatagcgcgggaagacctgctgaatgagatcaagtacatcttcagcatccagcgcaagctcgggtcgcccttcgtgaccgagaagctggaacacgacttcctgaacatctgggagttccagcgccccttcgccagcggcgactcaatcttgagcaaggtggggaagtgcacgctgctgaaggaggagctccgggccccaacctcctgctacaccagcgagtacttcggcctgctgcagagcatcaacaacctcgtcttggtggaggacaacaacaccctgacgctcaacaacgaccagagagccaagatcatcgagtacgcgcacttcaagaacgagatcaagtactccgagatccggaagctcctggacattgagcccgagatcctcttcaaggcccacaacctgacccacaagaacccctcgggcaacaacgagtccaagaagttctacgagatgaagtcctaccacaagctaaagagcacgctgcccaccgacatctgggggaagctgcactctaacaaggagtccctggacaacctcttctactgcctaacggtgtacaagaacgacaacgagatcaaggactacctacaggccaacaacctcgactacctgatcgagtacatcgccaagctgccgaccttcaacaagttcaagcacctcagcctggtcgccatgaagcgcatcatccccttcatggagaagggctacaagtactccgacgcgtgcaacatggccgagctggatttcaccgggagcagcaaactcgagaagtgcaacaaactgaccgtggagcccatcatcgagaacgtgacgaaccccgtcgtgatccgggccctgacccaggcccgcaaggtgatcaacgccatcatccagaagtacggcctcccgtacatggtcaacatcgagctggcgcgggaggccggcatgacccgccaggaccgggacaacctgaaaaaggagcacgaaaacaaccgcaaggcccgggagaaaatcagcgacctgatccgccagaacgggcgggtggcctccggcctcgacatcctgaagtggcgattgtgggaggaccagggcggacggtgcgcctacagcgggaagcccatccccgtgtgcgacctcctgaacgactccctgacccagatcgaccacatctacccctacagccgctccatggacgacagctacatgaacaaggtcctcgtgctgacggacgagaaccaaaacaagcggtcctacaccccgtacgaggtctggggaagcaccgagaagtgggaggacttcgaggcgcgcatctacagcatgcacctcccccagtccaaggagaagcggctgctgaaccgcaacttcatcaccaaggacctggacagcttcatctcccgcaacctcaacgacacgcggtacatcagccgcttcctgaagaactacatcgagtcctacctgcaattcagcaacgactcccccaagagctgcgtggtgtgcgtcaacggccagtgcaccgcgcagctccggtcccggtgggggctgaacaagaaccgggaggaaagcgacctgcaccatgccctcgacgccgccgtgatcgcgtgcgccgaccgcaagatcatcaaggagatcaccaactactacaacgagcgggagaatcacaactacaaggtgaagtatcccctgccgtggcactccttccgccaggacctgatggagaccctcgccggcgtcttcatcagccgggcgccccgccggaagatcacggggcccgcccacgacgagaccatccgctcccccaagcacttcaacaagggcctgaccagcgtgaagattccgctgaccaccgtgacgctcgagaagctggagaccatggtcaagaacaccaagggcgggatctccgacaaggccgtgtacaacgtgctgaagaacaggctgatcgagcacaacaacaagcccctgaaggccttcgccgagaagatctacaagcccctgaagaacggcaccaacggggccatcatccgcagcatccgggttgagacgcccagctacaccggcgtgttccgcaatgaggggaagggcatcagcgacaacagcctcatggtgcgggtcgacgtgttcaagaaaaaggacaagtactacctggtgccgatctacgtcgcgcacatgatcaagaaggagcttccctccaaggccatcgtacccctcaagccggagagccagtgggagctgatcgactccacccacgagttcctgttcagcctctaccagaacgactacctggtgatcaagaccaagaaggggatcacggagggctactaccgctcctgccaccggggcaccgggagcctgtctctcatgccccacttcgccaacaacaagaacgtcaagatcgacatcggcgtccgcaccgccatcagcatcgaaaagtacaatgtggacatcctggggaacaagtccattgtcaagggcgagccccggcgcggcatggagaagtacaacagcttcaagtccaactga

SEQ ID NO: 7237 - RNA, 3072 nt, synthetic construct
  misc_feature 1..3072: note = Cas9 variant
  source 1..3072: mol_type = other RNA
atgaagatcctgggcttcgacatcggggtggccagcatcggctgggccttcgtcgagggggacgagatccgcgactgcggcgtgcggatcttcaccaaggcggaaaacccgaagaccggtgaatccctcgccctgccgcgcagggaggcccgcggcgtgcggcgacggttagcccgccggcgcgtccggctcaatacgatcaagaagatcatttgtaaggagttcgacctgcgtctgagcgactacatcgccgacgacggcgagctcccgaaggcgtaccagaccaacaaggacaccaagtccccatacgagctgcggtacaaggccctgaacgagcgcctatctaaggaggagctggcacgggttatcctgcacatcgccaagcaccgcgggtacggcaacaagcacgcgaaggacggcgacgacaaggattccggcaaggtgaagaaggccatcggggagaacaagaccctactggagcagaagggctacgagagcgtcggcgaatactgcttccgggagttcttcaagtccatcaaggacaaggacggggagacccacaacatccccagccaaaacatccgcaacaagaagggtaactacgatcggtgcgtgtcccagaagcagctggaggacgagctcaagctgatcttcgccaagcagcgcaaactgggattcaacaaggaatttgaggacgccatcctcgaagtggctttctaccagcggccgctgaaggacttcgacgacaagatcggcgactgtatcttcttcgacaacgagaagcgcgcgcccaaggagagcatctccgccattgagttcgtcgccctaacgcgcatcatcaacaccctcaagtacctgagcaagaccacgggcgaagtgtacgagaaggagatcatcaacaagatctggcagaagatcttggagaacgggaagatgacctacgccgagctccggaagatactggccctggactccagcgtgttctttaaggacaaagacctcgactacaccctgggcatcaaggaggcggagaagatcaagttcatcgagttcaagaagctgatcaagttcaagaaggccctcgggtccttcgacggcctaagccgcgagatcctggacaatatcgccatgcagatcgccatcaccaaggatcggcagcgcctcctggagaagctggaggtcttcccattgaataaggagcagaaggagaacctctcccagctgaacttcagcaagtacatcgacctctccctgaaggccctgaaccagatcctccctttcatgcgggaggggcgccggtacgacgaggcgaaggacgacgcaaagctgcaggaaaaggccaagaacacgaagaaggaggagttcctgccgcccctcaaggagtttgacctgaacctgaccaaccccgtggtggcccgcgccctcgcggagttccggaaggtcctgaacgccctgctgaagaagtacggcaaggtacacaagatccacctcgagttcgcccgcgacatgcggctggacttcgacgagcgcgagcggctgatcagcatccagaatgacaacttcaacaagagacagctagctgaggacttctgcaaggagcacggcctagagcccagcaacgctaacatcctgaagatcaagctgtggcaggaacagcagtggcactgcatgtactccggggagctgatcggcatcccggacctgaaggaccccaccaagctccaggtggaccacatctacccctactctcggtccttcgacgacagctacaccaacaaggtcctggtgcgcgccgagtggaaccaggagaaggggaaccacacgcccttcgaggccttcggcggggataagaacaagtgggacaagatcgtggccctggcagagaagctcccgccgtcaaagaagctaaaccggtcagagaagtccaagaaagacaaacttctcgatgagaagttcaacgacaaggagctgggcttcctggcgcgcaacatcgtcgacaccggctacatcgcccggctcgtggccaagtacatcgatatgtacctggagttcctgcccttagaggagaatgagaacacctcgctggcccgaggggagaagggctccaagaagcacatcgggatcgtgaacggccgcctgaccagcgaggtccggcacaactgggggctagaccccaaggaccgcgacaaccacctccaccacgccatcgacgcgatcgtgatcgcctacatgaacgacaagcggatcaaggccttcgccgacttccgacggctgaaggagctgaagatcaagcgctacggccgagagatcacggaggacgagtaccaggagaagaagaaggagctgtcctgcgccccgttcgacgacttccgcaaccggaccctggagaatatcgacaaaatattcgtcagccgccctccccggaagcgagcgcggggcaccctccacgaggagaccttctactccatcgacgacaagaagctgctgaaggcctacgggggcaaggaggggatgcagcgcgccctcagcctgggcaagatccggcagataggcacgaagatcgtgaagaacgggaccatggtgcgcgtagacatcttcaaggacaaacggggccgcttctacggggtgccaatctataccatggatttcgcactgggagtgctccccaacaaggcagcggtctccgggaaggacaaaaacggcctgatcaaggagtgggccgaaatggacagcggatacgagttctgcttctcactgttcaaggacgacctcatcctggtgcaacggaaagagatgcaggagcccgagctgtgttacttcgtgtcattcgactccagcaacgcccagatcgacgtccgcagccacaacaaccacttctccgtgctcaacgaaaaccagaagctgctgttcaagagcgccacccaggcggaggtgatcggggagtccattggcatccagaacctcaaggtcttcgaaaagtggcacgtgagccccctgggggaggtgcggaaggccgagttcagcccccgcggcgaggccaagttaaagacgtccaagaagcgcaagaagtga

SEQ ID NO: 7238 - RNA, 3072 nt, synthetic construct
  misc_feature 1..3072: note = Cas9 variant
  source 1..3072: mol_type = other RNA
atgaaaatctacagctttgacatcggagtggcatccataggctgggcctttatagaaaacgaagtgctccaagactgcggtatccgaatctttacaaaagcagaaaaccccaaaaacggagccagtctcgcgctcccccgaagagaagcacgtggggtccggaaacgattagcccgccgacgaggacgcctcaacaccatcaaacaactcctctgcaaagagttcggccttcaactggaagattatctttccaacgacggagaactccccaaagcctacacagctagtaaagcaaatccgctaaaaagcccctacgaactccggaccctcgcactttcacaaaaactcgactccaaagacctcgtccgagtcattctccacattgccaaacaccggggctatggcaacaaacacgcaaaagactcgaaagacaccgaatcaggcaaggtcaagaaagccatcgaatttaaccggaaaaccctcgcagaaaagggctaccgctctgtcggggaatacctctaccgggagttcttccaacagagcagaatcagccaaaacaacggagcaaccgagttcatcaatgtccgcaacaaggccggaaactacgaacactgcgtagcgcaagacatgctaaaagaagaactcgagagtatccttaatgctcaacgccaattcggattctcactaaagcaagacttcgagagcaaactgctcaccaaaatcttcgaacaacgcccactcaagagcttcgccgacaaagtgggaaactgctgcttcatagcaggagagaaacgagcacccaaagactcgcccagtgccattgagttcattgcactctcacgcacaatcaataccctcattaatctatccaaagaaagcggagaaatatacaaccgtgcaattattttacaaattgtcgaatccaccttgaagaaaggagaaatatcttacaaagagctacgcgaaatcatccgactagacgaacgcctccgattcaaagaccccagactcgactactcccgagaaatcaaagaagcggaaaaagtcaagttcttagagttcaagcaactcaagggattcaagaaagcactaggagagagcttcacaacgctagccatctcacagttggacgaaatcgcagaacacatcgccctcatcaaagaccgcgtaaaactaaatgaaaaactagagtcgtacgcactaacaaaagaacaacgcgaagccctgtcaaacctcagcttttccgcccacataaacttgagcctacaagcactcaagcaaatcctaccgttcatgcgcggagacaatggagagcaatgcctcgactacgacgaatcagtcgaaaaagcaggcctgaaagccctttcaaaagacaccctgaaagggcagatgctgcccccactcaacgagttcgaaccctaccttagcaaccccgtcgtagcccgggccctcgccgaatacagaaaagtgctgaacgtcctcctcaaacagtacggctcgccccacaaaatacacatcgaatacgcacgcgaagcaaaactatcctccacagaacgccagaaatacgagaaagaacagaaagacaactacgccgccaaccaagccgcacacaagaaatgccaagagctgggactagaaccatctagcacaaacctcctcaaactaaagctatggcaagagcaaggaggactctgcttgtactcaggcgcaaagattaccatcagttaccttcaagacccgacagcgctccaagtcgaccatatatatccgtattcacgatcattcgatgattcatacatgaacaagtgcctcgtcctgaccaaggccaatcaagagaaaggcaacaggactcccttcgaggctttcggtactgattcggctaaatggggcgtcatcacgaccctggcgcaaaaactcccgcacaagaaacgtcgacgaatcctcaacactgccttcaacgacaaagaagccggatttaaactacgcaacctaaacgacacatcctacatagcccgtctagtcgcggactacacagaaacctacctcgaatttctaccacttgtagaatcggagaacaccacactctctaagggccaaaaaggctcaaagaaacacatagcaatcgtcaacggagtattaacgagcacaatgaggtactacctcggattcgcatcaaaggacagggacaaccacctccaccacgccctggacgcagtcatcatcggcttcatgaacgacagcgtaattaaggccttttccgacttcaagaaaactcaagaaacgtcaaaagcggcttactacgcgcacacactaagcaaacaagaatacaagaaacaacgcgccttcattcaactccccagcggcgagaacttcagagtctcagtcctcgaaaaagtcgagagcgtctttgtgtccaaacccccacgcaaacgggtccgcggggcactgcacgaggccacattctacagccctaacgacccaaagctcttaaagaactacggcggaaccaaaggcgtcgaacgagccctcgcactgggcaagatgcgaaaagtcggggccaaaatagtaagcaatggcgcaatggtgagagtagacatcttcagacacaaaagctccggcaaattctacggcgtccccgtatacaccatggactttgcgctcgggatcctccccaacaaggctgtcgtagtaggaaaagaccagaacggagtcataaaagactggctagagatggactcctcctacgagttcatcttctccctctacaaagacgacgtaatcctcgttcagaagaaagaaatgcaacgacccgaactatgctactttgtctcattcgacacaagtggcgcctcaatcaaagtggccaaacacgacaataacttttccacactaaccgagaaccaaaaactgctgttcagcaacgccacaaaagaagaggtggtcggaaaatccataggcatccagaacctcaaagtcttcgaaaaatggcaagtatcagtactaggcgaggtcaaacgaacccaatcctacccccgcgaaaacatatcacttgcctccaaagctaagaaatga

SEQ ID NO: 7239 - RNA, 3075 nt, synthetic construct
  misc_feature 1..3075: note = Cas9 variant
  source 1..3075: mol_type = other RNA
atgatccgcaccctaggcatcgacatagggattgcaagcatcggatgggcagtcatcgagggagaatacaccgacaaaggactcgagaacaaagaaatcgtagccagcggcgtaagagtattcaccaaagcagaaaacccgaagaacaaagaaagcctcgcactaccacgtactttggcccgctcagcacgcaggagaaacgcacggaaaaaggggcgaatccaacaagttaaacattacctatccaaagcactcggactagacttagaatgcttcgtacaaggagaaaaactagccacactatttcaaacatcgaaggacttcctaagcccctgggaactacgagaaagggccctctaccgggtgctagacaaagaagaactggcacgcgttatactgcacatagcaaagcgacgcggttatgacgacatcacttacggggtcgaggacaacgactccgggaaaatcaagaaggccatcgccgaaaacagcaagcgaatcaaagaggagcagtgcaagacaataggagaaatgatgtacaaactctacttccaaaaatcgctcaacgtccgaaacaagaaagaatcgtataacaggtgcgttggaaggtcagagttaagagaggagctgaaaaccatatttcaaatccaacaggaactcaaaagcccctgggtgaacgaagaactgatatacaaactgctaggaaaccccgacgctcaaagcaaacaagaacgtgagggactcatattctaccagcgaccgcttaaaggtttcggagacaagatcggcaaatgttcgcacatcaaaaagggggagaactcgccataccgggcctgcaaacacgcgccctcagcagaagagttcgtcgccttaaccaaatcaatcaacttcttgaaaaacctgaccaatcgacatggactctgcttctcccaagaagacatgtgcgtctacctcggcaaaatcctccaagaagcccagaaaaacgagaaaggcctcacatacagcaaactgaaactactgctagatcttccaagcgactttgagttcctcggcctagactactcgggcaaaaacccagaaaaagcggtattcctcagcctacccagtaccttcaaactcaacaagatcacccaagacagaaaaacccaagataaaatagcaaacatcctgggcgcaaacaaagactgggaagccatcctaaaggaactagaatcgctgcaactcagcaaggaacaaatacaaaccataaaggacgccaagctcaacttctcaaagcacatcaaccttagcctcgaagcattataccatctgctacccttaatgcgtgaagggaaacgttacgacgaaggagtcgaaatcctacaggagagaggcatattctcgaaaccccaacccaaaaaccgacaactcctcccgcccttatcagagctggcaaaggaagaatcctacttcgacattcccaaccccgtcctacgccgtgcactgtcggagttcagaaaagtagtaaacgcactcctagaaaaatacggcggattccactacttccacatcgaactaacccgagacgtctgcaaggcaaaatcagcccgaatgcagctggagaaaataaacaaaaagaacaaatccgaaaacgacgcagcgtcgcagctactcgaagtactgggactccccaacacctacaacaaccggctcaaatgcaaactctggaaacagcaagaagaatactgcctctactcaggagaaaagataacaatagaccacctaaaggaccaacgagcactacaaattgatcacgcattccccctgtcccgatcactagacgactcccaaagcaacaaagtactctgcctcacctccagcaaccaagaaaaatccaacaagaccccatatgaatggctaggcagcgacgagaagaaatgggacatgtacgtaggacgtgtatacagcagcaatttctcaccctcaaagaaacgaaaactaacccagaaaaacttcaaagaacgaaacgaagaagacttcctagcccgcaacctcgtggacacgggctacatcggccgagtcacgaaagaatacataaaacacagcctcagcttcctccccctcccagacgggaaaaaggaacacataagaatcatatcaggcagcatgacaagcacaatgcggagcttctggggagtccaagagaagaaccgggaccaccacctccaccacgcacaagacgcaataataatagcctgcatagaaccatctatgatccagaaatatacaacatatctcaaagacaaggagacacaccgactcaaatcccaccagaaagcacaaatactgcgcgaaggcgaccacaaactaagcctcagatggccaatgtcaaacttcaaagacaagatacaagaatcgatccaaaacatcatcccctcccaccacgtatcacacaaggtgaccggagaactccaccaagaaacagtaaggaccaaagagttctactaccaagcgttcggaggagaagagggcgtgaagaaggcactaaagttcggaaagatcagggaaataaaccaaggcatcgtagacaacggcgcaatggtacgcgtagacatattcaagtcaaaagataaaggaaaattctacgccgtacccatatatacatacgatttcgcgataggcaaactcccgaacaaagccatcgtccaaggcaagaaaaacgggatcatcaaagactggctggagatggatgaaaactacgagttctgcttctccctattcaaaaacgactgcattaaaatacaaacgaaagagatgcaagaagcggtgctcgccatatacaaatccacaaactcagcaaaagccaccatcgaactagaacacctaagcaagtacgctctcaagaacgaggacgaagagaaaatgttcacagacacagacaaggaaaagaacaagaccatgactcgggaaagctgcggaatacaaggattaaaagtcttccagaaagtgaaactcagcgtcctgggagaagtcttggaacacaagccccggaaccggcaaaacatcgccctaaaaacgacacccaagcatgtatga

SEQ ID NO: 7240 - RNA, 3078 nt, synthetic construct
  misc_feature 1..3078: note = Cas9 variant
  source 1..3078: mol_type = other RNA
atgggaggctacatgccccagctcatgcgctacaggctcgcactcgatatcggatcaaccagcatcggatgggctatgatccgcctaagcatgcaaaatgaaccgattgccataatcagaatgggagtccgcatattctcagacggccgtaacccgaaagatgggagctccctagcagtgacacgacgcgtcgcaaggcagatgagaagacgccgggaccgcctcctaaagcgcaaaacacgactgcttaacgccctcgtgcagaaaaagttcttccccgaggacgcagacgccaggaaagccctcgtcgtactcaacccctacgagctaagaaaagaggggctatacagacaactcagcggccccgagttcggacgagcactattccacatctcgcaaagacgcggcttcctatccaaccgaaaaacagacaagaaagacaacgactcctcagtcctaaagaaagcaatcgtagacctgcgtcaacagctcgaagtcgaaaactgccaaaccatcggtgagtggctgttcaagcagcaacaaagcgggaaaagcgttcgcgcccgcctgcgaggaaaaacacaaaaagacaaagcatacgacttctacatcgaccgagccatgatcgcacacgagttcgacaccctctgggtgagccaagccaagtatgacccactcctcttcaacgaggacgcaagagccatattacgggatatactgctctaccaacgcccgctcaaacccgtaaaacccggaaggtgcacactgatcccagatgagtcgcgcgccccactcgccctccccctgacgcaacaagcacgcatataccaagaacttaaccacttacgcatcaccacaccagcgcttggcgcccaggccctaacagtcgcccagcgcaacacaatagcagcgcttctagagaaatcagacgtaacattcgtgaagatcgccaaagcgcttggactaacaagcacgaccgagtttaacttacaagacataaaacgcgaccgactgaaagggaacgcaaccgctataatcctcgcacgcaaccaatatttcggccgacgctggcatgacttcaacgccgacctgcaaaacctcatcgtcgacaaactcgtcaacgaaggaagcgaaacagcccttatcgaatggctaaaagcaaacacagacgtagacgaatccgccgcagagcgggtatcaggagtcaccctgccggaaggatacggctcgctttccgtagcagcactaaggcgactcctcccagctcttaaagaagacgtcgtcgtttactcagaagcagttaaacgcgccggattcgacagccacagcgcgctaagcctaatagaacagacaggggagctctaccaagaactcccctactacggggaagtcctgcaacgacacgtcggcttcggctccggagatcccaatgatagccctgaaagaaggtttggcaaaatcgcgaaccccacggtccacatcggactaaacgaactaagaaaaataataaacgccctaattaagcgctacggcaacccagcagaagtcgtcgtagagctcgcccgagacctcaagctcagccgggagaaaagaaaagaaatccaagaagaacaaaaacaacgacaagaccgtaacgaaaagcgcataaaagacgcatgcgaaattctgggcatcgaccccctcgtgattgacagaggcaaacggagagaaataagccagaaaatgcaactctgggacgaacttaacccaaaagacgcagccaatcgtcgctgcccatacacaggcgatcaaatatcaatcgaaaaactcctgtcggccgaagtcgaaatcgaacacatcctaccatttagtaaaacactagacgactccctcaacaataaaacagtggcaatgcgtcgcgcaaaccgcgataagggaaaccgaaccccatacgaagccttcggagaatccctaaacccagactatgactacgacgcaatcttacaacgggcatcactcatgccacgggaaaaacgaaagagattcgcctcagacgggtaccaacaatggctcagagacgacaaggacttcctctcgcgagcactaaatgacactgcctacctatcaagaattgccaaggaatacttaaccctcatatgcccaccaaacagcgtccgggcaataccggggagaatgacagcccaattacgcgcaatgttcggtctgaaccgactactgtcagaaggcggaattaaaaaccgggaagaccacagacaccacgcaatcgacgcggccgtcataggcgtcaccgaccaggggctgctacaaaagttcagccgagcctcagcccgcacgcgtgaactccaactatccagactcgtagacgacatgcccctcccatgggacacctacagggaacacgtcacgcgagccctcgaacacctcgtagtgtcccataaaccagaccacggctaccaaggcaagatgcacgaggataccgcctgggggcttagggacaacggacaagtaacacgccgcgtgagaagcgaagacggcggtccccgccaacgacttcttgaaaacaaaaacgtagtcaagatcaactccacgcgggacttcagccgccacggcatagacgagcaaggccaagtcaacgcatacaaaggatatgtcgggggaagcaactattgcatagaaatctggatagacgaaaaaggaaagtggaatagcgacgtcgtctccacctttcaggcataccaaatcgtacgcgaactgggcgaaaaggcagcctggcaaaaattgcgcaatcccctactatcactctctgcaaagccactcgtcatgcgcctaatcatagacgacgtcgtaaaaatgcaaatagcagggcaaaacaaaatcatgcgggtcgtcaaaatagcacaaaacggacaaatatttttcgcggaacacaacgaggcaaacgtagacgcgagagacaaagacaaaaacaaccccttcaaatacattagcaagacggccgggagcctacaaaaagcgggcggcatacatatggcaatttcacccatcggcgacgcacgccccgtccgctacggtcgctga

SEQ ID NO: 7241 - RNA, 3084 nt, synthetic construct
  misc_feature 1..3084: note = Cas9 variant
  source 1..3084: mol_type = other RNA
atgaagtacaccctgggcctcgacgtgggcactaatagcatcggctgggccgtcctggagctgaacacgaatggggagccccagcgcatcgagaagctgggctcccggatcttcaccgacgggcgccacccgaaggacggcacaaccctagccagcaagcggcgccagaagcggcacgaacgccggaggcgggatcgcttgcaccagcggaaaaagctcgtgctgaaccagctggtgtccatgggcctcttcccccagagtgagcaggagcagcaggacctgaagtccttggacgtcctcacgctgagagcgaacggtgtgagcaaacagttatctgcctacgagctcggccgggtgttctactatctgaacctgaagcgcgggttcaaaagcaaccggaagggcggttctgaagaggacaaggccaataaaatcagcgagcgcatcaagaagctccaggagcagctgaaggagaacgacttcaaaaccgtcggccagtacctgcacgaccggtacatcaagggcctctccacaaaggccacaatagagaacgacttccatctcctgcgccaactgatcgaggacgagttcgacttcatcgtggagacgcagagcaagtttttccccgagatctccgacgagcagtggaacaccctgcgcaaccgcatgttccaccaacggcccctgaagccggtggaaaccgggacatgtagcctcttcgaggacaagaagcgcacatacaagtacatgccctccttcgaggagtaccgcttcttaaccgagctgtttaacttaagttatcaggatgagaacttccactcccacagcttgtccagcgagcagatcttcaaagtctttcacgagctgaagaacacccgggaggccacctacacgaagattaagaagctcctgaagctgcccagcgacttgagtttcagcatcgagcgctcaaagagcaaggacaaaataaagatctccaccaccaaccatttcttcagcaagtccctgctgttcgcggaggagtgggccagcctcgacctgaagctgaaggacgaagtggccgagatatacttctctgacatgagcgtggaggagatcaagaagggcctcctgcagctgaagatcgattccgagatcatcgaaaatctcctggaggaaaaggtcccaaatgttcaggaggcgacctgcagctacagtaaggaggccctgcaaaagatcgtgagcctcatcctggaggaagagaggcacccgacactgatcgtcgacgacctgttcaaaaacgagaaggaggaaacctccctcatcgaccgcctcgactactacggggccagcatccccgactccatgcagcccatcccccagcacatcaaggacaacaatctgaccctcaacgaggatgagaagcggtatggcaagatcgccaacccgaccgtccacgccgccctgaaccagatccgccaggtggtcaacgacctgatcgagcagtacgggaagcccacgaacatacacatcgagttcgcgcgagacctcaagaagtccaaggaggaacgcgacttcgacaaccggaagaagaagaagaatgaggagctgaacgagcaggtccgcgacttcatagagaagcacaatcagaagccaagcgccttcaacttcgagcgggtaaagctgtggttcgaactcgacgccatgaacaaccaggtgtgtgcctacagcggaaagaccatcagcgcccgcatggtgctgtccgacgaggtgcaagtcgaccacatcctgcccttcagcagaaccctcgacgactcactggccaacaaggtgctggtcctcgccagcgagaacgtgaagaagcgtaaccggaccccgtacgaggccttcggccaggacacggagaagtgggcctccattcaggagttagccaagcgcctgccctaccacaagcagtggcggttcgcggaggatgccatcaagaagttcgaagagaaggaccagttcttgcagcgccacctgaacgacacccggtacatcagcaagatcgccaagaagtacctggggtccatcaccgatccctacaagatcgtggccagccgcggccagatgacctccatcatccgcgggaagctcggcctgaaccagttcatccagaagcccgacgggacgaagaaccgagaggaccaccgccaccacgccatcgacgcgctgaccgtggccctcaccagccggagttacttgaagcgcataagcgacgcctccgcccggaaccaggacccgaaccgcatccccatacccgagccctggaaggggttcatcaaagacgcggacgtgaagttcaacgagatcatagttagccacaaggttgaccacggcaagaacgggccgttcatggaggaaacctgcttcggccttatcaaaaatcccaacaagtacgaggaggagaacgacttcaagctgatcacgaccaagtcactggacagcgtcaaggacccctccaccatccggagccagtcactgcaaaacctcgccgaaaagagcggggtcatcagcctggccaagtccggcgtcaagaagctgcgcgtgtacgacgtgaccaaggagaaccctgccgacattggactcatcgagagcgggctggctaagatcacgcacggcaaggacaagcagcatgtgaaacactaccaaaagggggacataaattacctggcgatctggtgcctcccgcaaaacatcacactgaagtccgacaaccacaagaagcggaagaccgactacatattcaccgcgattaagaccttcgacctgaacagcaagaaccccaacgacctccgtccacacccggcagccaagctggtgacaaaggtgtacaagggcgacaccgttgccctggaggtaaacaaccagctcaactactacatagtgaagtccatccgggcggccaacaagaagctgtacttcctgaaaatcaaccagagctctgagctcgccaacgagacccagtttatacccgcatacaccaaactggtcgactacaagttccgcaaggtgagcgtgtcccccacgggggtcatcaccgacaacggccccctgctcaagtga

SEQ ID NO: 7242 - RNA, 3090 nt, synthetic construct
  misc_feature 1..3090: note = Cas9 variant
  source 1..3090: mol_type = other RNA
atgagatccctccgatacagactcgcactagacttaggaagtacttccctaggatgggccctgttccgactcgacgcatgcaacagacccacggcagtcattaaggccggtgtcagaatattctcggacggaagaaacccaaaggacggatctagcctcgccgtaacgagacgagcggccagagcaatgcggcgccgacgagaccgattattaaaaaggaaaacacgcatgcaagcaaagctagttgagcacgggttctttccggccgacgcaggaaaacgcaaagcactggaacagctgaacccatacgccttacgggcaaaaggcttacaggaagccttactgccgggcgagttcgcccgagcactgttccacatcaaccaaaggcgcgggttcaagagcaaccgcaaaacagataagaaggacaacgactcaggggtcctaaagaaagccataggacagctgagacaacagatggccgaacaaggaagtaggaccgtaggagaatacctatggacgaggctccaacagggccaaggagtccgagcacgctaccgcgaaaaaccgtacaccacagaagaaggcaagaaacgaatagacaaaagctacgacttgtacatagacagggccatgatcgaacaggagttcgacgcactctgggcagcccaggccgccttcaacccgacgctatttcacgaagccgcccgagcagacctcaaagacaccctactccaccagcggccattacgaccggtaaaacccggaagatgtaccctactaccggaagaagaacgagcaccactcgcactgccctcaacacaacgatttcgaatacaccaggaagtcaaccatctgagactgctagatgagaacctcagagaggtggcactaacactggcccagagagacgcggtggtcacagccctagaaacaaaagcaaaactctccttcgagcaaatcagaaaattgctaaagctatcagggtcggtgcaattcaacttagaggacgcaaaacgcacggaactcaaaggcaacgcaacatccgcggccctcgcgagaaaggagctattcggcgcggcctggagcggcttcgacgaagccctccaggacgaaattgtatggcagctagttaccgaagaaggtgaaggagcactaatcgcatggctacaaacccacacgggggtagacgaggcaagggcccaagcaatagtagacgtaagcctacccgaagggtatggtaacctcagccgaaaggcactggcgcgaatagtgccagccctgcgagcagccgtaatcacatacgacaaagcagtccaagcagcaggattcgaccatcacagccaactgggattcgaatacgacgccagcgaagtagaagacctcgtacacccggagacaggagaaatccgttccgtgtttaaacaactcccctactacggaaaagctctacaacgccacgtggccttcggatccggcaagcccgaggacccagacgagaaaaggtacggaaaaatcgccaaccccactgtgcacatagggctgaaccaagtgagaatggtcgtaaatgctctgataagaaggtacggacggccaacagaagtcgtcatcgaactcgccagagacctgaaacaaagcagagaacaaaaggttgaagcacagcgacgacaagccgacaatcaaaggagaaacgccaggatacggcgaagcatcgcggaagtcctggggataggcgaagaaagggtacgaggcagtgacatacaaaaatggatatgctgggaggagttgtcattcgatgccgcggacagaagatgcccctacagcggggtacaaataagcgcagcaatgttactaagcgacgaagtagaggtggaacacatcctgccattcagcaaaaccctagacgacagcctgaacaaccgcacagttgcgatgaggcaggccaatcgaatcaagcgaaacagaacgccatgggacgcccgcgcggagttcgaagcacaaggatggtcatacgaggacatcctacaacgagcagaaaggatgcccctgagaaagagataccgattcgcaccggatggatacgaacggtggctcggagacgacaaggacttcctagccagagcgctgaatgacacaagatacctatcacgagtggccgcggaatacttaaggctagtatgcccagggacacgggtaatcccaggccaactcacagccctgctccggggcaaattcggactcaacgacgtactaggactagacggagagaagaacagaaacgaccacagacaccacgcggtagacgcatgcgtgataggcgtgacagaccaagggctcatgcaaaggttcgccaccgcaagcgcacaagcccgaggggacggtctaacccgacttgtggatggcatgccaatgccgtggccaacctatcgagaccacgtagagcgggcggtacgtcacatatgggtcagccaccgcccagaccacggattcgagggcgcaatgatggaggaaacatcatacggaatacggaaggacggaagcatcaagcaacgaagaaaagcagacggcagcgcaggcagagaaataagcaacctaatacgcatccatgaagcaacgcagcccctacgacatggagtctcagccgacggccagccactcgcctacaaaggctacgtaggagggagtaactattgcatcgaaatcacagtcaatgacaaaggcaagtgggagggagaggtaatcagcacgttcagagcatacggcgttgtaagggcaggaggaatgggacggctaaggaacccacacgagggacagaacgggcggaaactcatcatgcgactcgtcataggggactcagtcagacttgaagtggacggagccgaaagaacgatgagaatagtaaagataagcggcagcaacgggcaaatcttcatggcaccaatacatgaggcgaacgtcgacgcacgcaatacggacaaacaagacgcattcacgtatacgtcaaaatacgccggtagcctacaaaaagccaaaacgcgacgcgtcactataagccccatcggagaggtaagggacccgggcttcaaaggatga

SEQ ID NO: 7243 - RNA, 3090 nt, synthetic construct
  misc_feature 1..3090: note = Cas9 variant
  source 1..3090: mol_type = other RNA
atgaaataccgcctagcactcgacctaggatccacatcactcggctgggcgatagtacagctaaacgcaaaagacgaaccatgcgccatagtaagagccggggtaagaatattccccgacggacgaaaccctaaggacggttcaagtctagccgtcacccgacgaaacgcacgcgcgatgcgacgacgcagagacagactgctgaaacgaaaggcacgtatgcaacgactcctaatagaacacgacctattcccagcagacgaagccgcgcgaaaagcactggagacactcaacccatatgaactcagagcgaaaggactggacgcagcccttactccggcagagttcgcgcgagccctcttccacctaaaccaacgccgaggctttaaaagcaacaggaggaccgaccgcaaagacaatgactcaggagccctcaaggccgcaatcggagggctgcgagcacaactagacaccgcaggggcggacgggagagcaagaaccgtcggagaactactctggcgacgtatgtccgacccaaacgtcctaacagtaagagcacgctacagagaacaacggatcacaaaagatgacggtaaaacacgcgttgataaaagctatgacctatatgtggaccgagcaatggtagaagcggaatttgacgcactgtgggccaagcaggccgagctaagcccaacgcagttcggcgaggcagcgcgcgcaacactaaaggactgcctactacaccaaagaaacctcaggccagtacggccaggccggtgcaccctcgaaccagacgaacccagggcgcccctcgcccttccatcccaacagcgcttcagaatcctgcaagaagtgaaccacttgagactattaggaggcaggctgcttgaagagtcattaagcgtcgaacaaagagacaagttagtcgctgccctagaagacggcagcaagagcttcaaaacggcaataccaaaactgctgggactaccaggaacggttcaattcaacctcgctgacgcaaaaagaaccgaactcaaaggaaacgcaacgtcaatgctcctcggaaagaaagacttcttcggaccagcctggcacggattttcagaggcacgacaagacgaaatagtaatgaggatacaagaggaagaatcagaagccaggctagtcgactggctcgcaacaagcaccggcgtagacgaggcacacgcactaaaaatcgcgaacgcagcccttcccgagggatacggctcactgagtgccaaagcactagcaaagatactccccgccatgcgcgcagaagtaataacatacgacaaagctgtactagccgcaggctacgaccaccactctcacataagccacgcagcctccacaggggagatactccccgagttaccctactacggcgaatacctccagagacacgtgggattcggcaccggcgaactaaacgacacacccgagaagagattcggccgcatagcaaaccccacagtgcacatcggactaaaccaggtaagagtggttgtgaacgcactgataaaaagatacggccaccccaccgaggtgatcgtcgaagtggccagggacctcaaacagagccaggatcaacggcgcgaaacacaagaacagcaggcaaagaatcagaaaaggaacgagcgattaagaaaagacgccgcagcaatactcggcattgcagacgagagagtgcgactagcggacatacaaaaacttatactgtgggaagaactgagtttcgacatagccgatcgacggtgcccctacagcggcgtacagctcagcgccgcgatggtgctaagcgaacaggtcgaaatagagcacatactgcccttcagcatgacactggatgacagcctaaacaacaaaaccgtagcaatgcgactggtaaaccgactcaaaggaaaccggaccccttgggacgcgcgagaggcattcgcggggcaaggatgggactatgacgggattctcatgcgagccgagagaatgccgagggcaaagcgacaaaggttcgcgccagacgggctcgaaaagtggctgaaagaagacaaggacttcctagcgagagcactaaacgacacacgacacctctcacgcgtggcgagagaatacctcagtctagtatgccccgcaagcacccgagtaatcccaggccaaatgacagcgatgctgcgcgcgaaattcggactcaacgacatcctaggattgaacggagagaaaaacaggaacgaccaccgccaccacgccgtcgacgcatgcgtggtcgcagtcacagaccagggactccttcaacggttcgcacaagctagtgcagacgcacggggaaaaggactggacagactcgtcgaaacaatgccagacccatgggacagctaccgcgagcacgtacaaagagcagtaaatagtatctgggtaagccacaagccggaccacggatttgagggagctatgcacgaagacaccacgtacagaccgccccacctcgaccccaagaacatgtggagaacacgcgggattggagggggcaagccaaacgagaaggaagcagactcaaaagccatggtcgggttcacagggccagagcatctgcagagacaccaccgcgacaaggccggacaacaactaccgtacaaaggatacgtcgcaagccccaaattttgcatggacatcgtgagaaatgacaagggcagatgggaaggagaagtcgtcagcaccttcgaagcatacaggctcgtcagtgagttcgggagagacgccgccctcgcacacatccaaagcaaaagccgaagcatttcgggcaagccactcgtaatgagacttcaaggaggggacatggtgagatttgacgacgacgaaggcaggcccgtagtcctgcgcgtggtaaacatgacaggaaacggtcagatcttcttcgcgccacacaatgaagccaacggcgacgcaaggaacagagacaaacaagaccaattcgtctacctcagcaaatacgcagggtccctacagaaagcaagagggaggagagtaacagtaagcccagcaggagagttaagagaccccgggtttaaagaatga

SEQ ID NO: 7244 - RNA, 3090 nt, synthetic construct
  misc_feature 1..3090: note = Cas9 variant
  source 1..3090: mol_type = other RNA
atgagatcactacgatacagactggcactcgacctagggagcacgagtctcggatgggcactgttcagactagacgcctgcaacagacccacggcggtgataaaggcaggcgtacggatattcagcgacggccggaacccgaaagacggctctagcctagcagtgacccggcgcgcggcacgagcgatgcgacgacgaagagaccgactcctgaaacgaaaaacccgaatgcaggccaagctagtggagcacggattcttccccgcggatgcaggcaaaagaaaagcactcgaacagctaaacccctacgcgctacgagcaaaaggactccaagaagcactcctgccgggtgagttcgcaagagcactattccacataaaccagcgccgcggatttaaaagtaacagaaagacagataagaaggacaacgacagcggcgcactaaagaaagcaatcggccaactacgacagcaaatggccgaacaaggaagcaggacagtaggagaatacctgtggacaagactgcagcaaggccagggcgtaagagcaagataccgcgaaaaaccatacacgaccgaagaagggaagaaacgcatagataaaagctacgacctctacatagacagagccatgatcgaacaggagttcgacgccctgtgggcagcacaagcagccttcaacccgaccctattccacgaagccgctcgcgcagacctaaaagacaccctcctccaccaaaggcccctccgccctgtaaaacccggacgatgcacgctcctcccagaagaagaacgggctccactagcgctaccctcaacccaacgattccgaatccaccaagaagtaaaccacctacgcctcctagacgaaaaccttcgcgaagtcgccttaactctggcccagcgagacgcagtggtcacagccctagaaacgaaagcaaaactgtccttcgaacagatacgaaaactcctaaaactatccggcagcgtacaattcaatctggaggacgcaaaaagaacggaactaaagggtaacgcgacgagtgcagccctggccagaaaggaactattcggagcagcatggagtggattcgacgaagcgctgcaggacgaaatagtgtggcagctagtcaccgaagaaggagaaggtgcattgattgcctggctacaaacacacaccggagtggacgaggcacgagcacaagcaatcgtagatgtcagcctaccagagggatacggcaacttatcaagaaaagccctagcccggatcgtaccagccctcagagccgcagtaatcacttacgacaaagccgtccaggccgccggattcgaccaccactcacaactagggttcgaatacgacgcaagcgaggtcgaagacctagtgcacccggaaaccggagagatacgaagcgtctttaaacaactaccgtactacggaaaggcactgcaacgccacgtagccttcggatccggaaagcccgaagacccagacgagaaaaggtacggaaaaatagccaatccaaccgtacacattggactcaaccaggtcaggatggtcgtaaacgcgctaattcgccgatacggaagaccgacagaagtagtgatcgaactcgcacgggacctaaaacaaagccgcgaacagaaggtcgaggcacaacggcggcaagcggacaaccaacggagaaatgcaagaatccgcagaagcatcgcagaggtacttggaatcggtgaggaaagagtacgaggatctgacatacagaagtggatctgctgggaggagctgagcttcgacgccgccgaccgccgctgcccgtatagcggagtccaaataagcgcagcaatgctcctcagcgacgaagtagaagtagaacacatactgcccttctccaaaaccctagacgacagtcttaacaaccgaaccgtagcgatgcggcaagcaaatcgcataaagcgcaatagaacaccctgggatgcaagagcagagttcgaagcacagggatggtcatacgaagacatactccaaagagcggaaagaatgccacttaggaaacgatacagattcgccccagacggctacgaaagatggctcggcgacgacaaagacttcctcgcccgagccctaaacgacacaagatacctttcgcgcgtggcggcagaatacctacggctagtgtgcccaggtacgagagtaatccctggccaactgacagcactcctccgaggaaaattcggactcaacgacgtcctcggtttggacggggagaaaaacagaaacgaccaccgccaccacgccgtggacgcctgtgtcataggagtaaccgaccagggactcatgcaaagattcgcgaccgctagcgcccaagcacgaggagatggactaacaaggttagtagacggcatgcccatgccatggccaacataccgagaccacgtcgaaagagcagtaagacatatatgggtaagccacagacccgaccatggcttcgaaggagcaatgatggaagaaacaagctacggcattagaaaagacggaagcataaaacagcgccgaaaagcagatggcagcgcaggcagagaaataagcaacctgatccgaatacatgaagcaacccaacccctaagacatggcgtctcagccgacggacaacccctcgcctacaaaggatacgttggagggagcaactactgcatcgagataacagtcaacgacaaaggcaaatgggaaggggaagtgatttcaacattccgggcctatggcatcgtacgagccggagggatggggcgcctccgaaacccacacgaaggccaaaatggccgaaaactaataatgaggctggtaataggagacagcgtgaggctggaggtggatggcgccgaacgaacaatgcgaatagtcaaaatatcgggcagcaatggccagatatttatggcgcccatccacgaggcaaatgtggatgcccgcaacaccgacaaacaagacgctttcacatacacaagcaagtacgcgggcagcctacagaaagccaagacgcgcagagtaaccatttccccaataggagaggtgcgggacccaggcttcaagggctga

SEQ ID NO: 7245 - RNA, 3096 nt, synthetic construct
  misc_feature 1..3096: note = Cas9 variant
  source 1..3096: mol_type = other RNA
atgccagctatatatcgcctcgcactagacctcggcagcacaagcctcgggtgggcagtattgagattagagccagcagcgctcgagcccatcgctataatcaaagccggtgtccgaatcttcagtgacggacgcaacccgaaggatggagccagtctagcagtaacacgacgcgcagcgcgagcaatgcgacggaggcgagaccggctattaaaaaggaaagcgagaatgcaagacaagctagtgaaacacgggttcttcccttcagatatggacgagcgcaaagccctggagaggctggacccatacgccctgcgggcgaaaggcctgcgagaagcactcaccccgggggagttcgcccgagccctattccacatcaaccaaaggcgaggattcaaaagcaaccgaaaaacggacaaaaaggacaacgactcaggcgcgctaaagaaagcgatcagccatctgcgacaacagatggaagccgggggacacaggacagtcggcgatcacctatggagccgcctgcaacaggggctgggcgttagagcgcgctaccgagagactccattcacaaacgacgaaggaaagaaaagaatagacaaaagttacgacctatacatagatagggcgatgatcgaacaggaatttgacgccctgtgggcagcacaggccgcattcaacccagcgctattccacgaagtagcgagagccgacctgaaagacacactgttacaccaacggcgcctacggccagtaaaacccgggagatgcaccctacttccggaagaggaaagggcacccctcgccctgccgagcacacaaaggttccgaatatatcaggaagtaaaccacctacgcctgctaggggaagaccttagagaagtagccctcacactggcgcaaagagacgcagtagcaaacgcattagaaagcaaagcacgtctaacatttgagcagatcaggaaactgctaaaattatctggatcggtccaatttaacctggaagacgcaaaaagaacagaactcaaaggcaacgcgacgagcgcggcactggccagaaaagaactcttcggagcggcctggggcgggttcggagaagccctacaggacgaaattgtctggcagctagtaacagaagagggcgagggagctctaattgcctggctgcaagcgcatacaggcgtagacgaagccagagcgcaagccatagcagacgcgtcactaccagaaggatacggaagcctcagcagaaaagcgctcgcaagaatagtgccagccctgagagcaggcgtagtcacgtacgacaaagcagtgcaagcagcaggattcgaccaccactcgcaactgggattcgagtatgacgcgggagaagtcgaagactgggtgcaccccgacacaggagaaatacggccggtctttaaacaactaccatattacggaaagcccctacaacgacatgtcgcattcggaagcgggaaacccgaagatccggacgaaagaagatacggtaagatcgcaaacccaacagtacacataggactaaaccaagtacgaaccgtcgtaaacgcattaataaggcggtacggaagaccaacagaggtagtaatagaactggcacgcgacctcaaacaaagccgggaacaaaaggtggaggcccaacgtaagcaagcagaaaaccaaaggagaaacgcgcgaatccgaaaatcaatagcggaggtactagggataggagaagaacaagtccgaggagcagacattcaaaaatggatctgctgggaggaattatcattcgacgtagcagaacggaggtgcccctacagcggagtacaaataagcgcgcgcatgctactcagcgacgaagtagaggtagaacacatactaccattcagcaaaacactagacgacagcctaaacaacaggacagtcgcaatgagacaagcgaacaggatcaaacggaaccgaacgccttggaccgcacgtgacgacttcgaggcacagggatggtcgtacgagggcatactccagcgagccgaacgaatgccgctaagaaagcgatataggttcgccccagacggatacgaacgttggctgggagacgacaaagacttcctcgcccgcgcacttaatgacactaggtatctctctcgcgtggccgcagaatacctacgcctagtctgcccgggttcaggcacccgagtgataccaggccagatgactgcaagacttagaggaaaattcgggctaaatggagtcctgggcccagatggggaaaagaacaggaatgaccatcggcaccacgcggtcgacgcatgcgtaataggagtcacagaccaaggactaatgcaacgattcgcaaatgcgagtgcgcaagctcgggaagacggactaaccagactggtggacgacatgccccgaccatggcccacgtacagagcccacgtagaaagggcagtacgccacatatgggtgtcgcaccgaccagatcacggatttgagggagccatgatggaggaaacgagctacggcatcggaaaggatgggtccataaaacaacgtagaaaagccgatgggagccctggcagagaaataacaaaccttatacgcatccacgaagcaacgcaaccacagaggcacggagcggggcccgacggacaaccattaccgtacaaagggtacgtaggaggaagcaactactgcatagagatcacaaggaacgacaaggggaaatgggagggagaggtcataagcacgttccgagcatatggaatagtccgaacgagcggcttaggtcaattacggcatccacgagtgggacagaacggaagagagctcgtcatgcgactggtaatcggggactcagtaagactcgagatagacggaatagaacgaaccatgcgcatagtaaaaataagcggcagcaacggacaaatcttcatggcaccaattcacgaggcaaatgtagacgcacgcaatagcgacaaacaggacgcattcgcatatacatccaagtacgcgggctcattacagaaaacaaaagcacgcttcgtgacaatatccccgatcggcgaagtacgagaccttggcttcaaagggtga

SEQ ID NO: 7246 - RNA, 3099 nt, synthetic construct
  misc_feature 1..3099: note = Cas9 variant
  source 1..3099: mol_type = other RNA
atgaagaagcgcatcctaggcctcgacatcgggatcgccagcgtgggctgggccctggtggagttcgacgacgaatttcaggacaacaaaaagaaggggaccatcatcaagtccggagtgcggatcttcacccgcgcggaaacccccaaggagcgggagagcctggccaagccacgccgggaggcccgctcccaacggcgccggatccgccggcgggtggagcggctcaacagcatccgtgagctgttcgtcaagaacggggtggtggaggagtggtccgtcagcaagaagaaccccaacaacatctatatcaccctgaaccagatcaagaccccctggcagctccggatggagagcctggatcgcaagctgaccaacgagcagttcgccgtggttctcacgcacctggccaagcaccggggctacaagagcctgcgcaaggacgacaaagcgggaaaggtacttgaggccatctctcagaacaagaagcggctgaacgacagcgactacaggaccctgggggagatgttctgcaaaaacgagtcctacaaggagcacaagcgcaacaagggcggggaatacattaacagcgtggcccgcgagttgatcgaggaggaggtggagaagatcttcgtcaagcagcgcgagaagggcaacaacttcgcggacgtgaataccgagcgggagtacctgaagatcgcgttctcccagaagcccgccgggagcatctccaagatggtgggcttctgcaccttcgagaacggtgagaagcgcgccccgcgggacagctactccgccgagttatttaaggtcctctgcacgatcaacaataccaccttcaccgacatgaagacgggcgagatccgcagcttttccaaggaggagatcgggaagaccctggagaccgtgaagaacgtgaaggacgtcaagtacgccaagatccggaaggatctgggtctcgaggacagcgtgaagttcagcggcgtggactaccgcgagaacgcgaagtccaagggagagggggagattttcgtcagcatgaagacctaccacgagattaagtctaagatcgagaaactgagcaaggaaaaatgggacaacttaaagggcaacacggagctcctggactccatcgtgaacattatcgccaacctgaaggacgacgagagcatcaagaaagagttccaaaagctcaagatcgacgaggacatcatcgatgtgctgctgaacttcgagttcaaaaagttcatcaacctctctttcaaggccctgcggaagatcattcccttccaattccaagggcagaagtacatcacggccagcacctccgccggctacagcttaaagcaggaggggatcaagaacaagctcgtcccgcccgctaaggaaaacatcaacgtggccgtcgtggcccgcgccttcgcccagacccgaaaggtgatcaatgcggtcatccgcaagtacggccagttcgaccagatcaacatcgagttagccacggagctgaagaactccaagttcgaccggagcaagatcgaggagggccagaagaagttccagtcccagaaggacaagatcttcaaggaggtgcaggagctccgcgggggcatgacccccagctccagcctactgctcaagtaccggctgtggcgcgagcaggatgagcggtgcgtgtactccgggcgcaagatcagctttgaggacctgctcgacaccggctttctggacatcgaccacatcatcccctactccaaaagcatggacgacagcttcaacaacaaggtcctgtgcctcgccgaggagaaccggaacaagaagaacgatatccccttcaactactaccagcgcatcgaccgggattggaacctgctgatctccatcatcaccagcatgaagaacatgaagatcgcgaagaagtccagactcctgaagcaggagctgagcgacattgaaggattcatcgagaggaacatcaacgacacacggtacgccacccgctacatcaaggacttcctggagaataacctcgagttcaaggagaacgagttcataaaggtgaaggtgcaggcgcggtccggcggactgaccagcgtcctctcctacaactgggggatgagcaaggatcgcgaggagagctacttccaccacgccaaggatgccattatcgtggcctgcagcacgcagggcatggtgcagtacatctccaagatcagccagcagtacgagaacgacaaggacaagatgaagaagatcaaggacaagacggagaactgcatccccaagccatgggactccttcagggccgacgtcgaggagagcattgaggggatcttcgtgtccttcgcgccccgccacaaagtgacagggagcgcccacaaggagaccatctactccaagaagcacctcgagaaggagcggtacgtcacggttaaaaagtccctggacaagatcaagctgtctgacctcgagaacatcccctgcaacgagaactgcgggatcatccgcgtgttaaaggagcggctggagaagttcaagaacgactcactcaaggccttcgccgaccccgtccacatgccgacgaagtgccccaacaagaagggtcccgtgatcagaagcgtgaagatcaaggagtccaacaagaccggcattgaggtccggaaagggctggccgagcgcggcgagatggtgcgggtggacgtcttcattaaggacaagaagtactacctggtgcccatctacgtgagcgacttcaagaacaaggacctcccgaacaaggccatcgccgccctgaagctggagaacgagtggattatgatcgacaagacctactccttcaagttcagcctcttcaaggacgacttaatcaagataaagaagaaaaaggaggagatcttcgggtacttcggcggcgtccaccgctcgaccgggacgatcaagatcaagagccgacacaagcccaaggagatcgacgaaggcatcggttctcgctgcctgctagatttccggaagtttcaggtggacgtgctgggcaactacaccgaggtcaagcacgagaagcgcatgcccgcttacatcacccggaaggacaagaaacactga

SEQ ID NO: 7247 - RNA, 3105 nt, synthetic construct
  misc_feature 1..3105: note = Cas9 variant
  source 1..3105: mol_type = other RNA
atgaaaattctaggcttcgacatcggcatagcctccatcggctgggctttcgtcgaaaacggcgagctacgggactgcggcgtccgcatcttcaccaaagcggaaaacccgaaaacgggtgactcactggcaatgcccagaagagaggcacggtcagtcagaagacggctagcccgccgtaaaggacggctagagacgctcaagcgcctcctcgccaaagagtgggacctatgttacgaagactacatcgccgcagacggcgaactccccaaagcattcatgggaaagaacctgaccaacccctatgtactgcgctacgaagccctgcagcgcttactcggtaaggaggaactcgccagagttatactccacatcgcaaagcaccgcggctacggaaacaagaacgcaaagatcaccaagagtgaagagtcgaagagggagcaaggcaagatcctctcagccctagctacaaacgccagtgtcatagcccgctaccgaaccgttggagagtacttctacaaggagttctgtgaagtcatcaagaacccccaaggactcaacacaaacgaaaactgcacccagccgaaagtccgggtgctaaaacccatccgaaataaaggcggcgaatacaccaattgcatactccaggaagaccttcaacgagaactaagatgcatcttcgaacatcaaaaaggcttcgggttccccataacacaagagttccaagacaaaatactcaaaatcgccttctaccaacgctccctaaaggacttctcccacctcgtaggcaaatgcacattctaccccgacgaaccgcgtgcgccaaaattcagtctatcagcgatagagttcatcaccaaagcaaaaacgatcaacctcctagtcggcatagtaaaagaaagcggcgaagtctgggataaagaacagtggcgcgaaagactagactcagtctttagcgcagtgtgcgaaagaggtaacctcacgttcgctcagatgcgcaaaatactgaagatcgacgaacgcatacaattcaaagaggtcgactataccgcaaagaacccagaaaataagaaattcgtcgagttcaaaaacctaaagaaattttgcgaaatacttggtgcaatcgtcggcgaccgcgcgctcgctgactccatagcacgggatatgacactaataaaagacgaagaagaactggcacaaaaactccgaggctacgggaaattctctcaagaacagatcacccaactcggggccctgaatttctcccaccacatcaatttatcactaaaagcgctcagtgaaatactccccttcatgcgagaggggatgcgatacgacgaagcctgccaagaagcaaaactacaagccaaacacaacgacaagaaaagcaaattccttccacccttctgcggttcaatctacgccgatgaactaactaacccggtggtacaccgcgcaatagccgagtacagaaaaatcctcaacgcattaatcgcaaaatacggcaacgtccacaaaatacacatcgaactcaccagagacgtaggcaaaaacttccaggaacgagagaaatacaagaaagaaatcgaaagcaactacaaagctagagtacaagccatgcaagaatgcgaaaaactcggattgacgctttccgaaggaaacatcctaaaactccgcctattcatggaacaaaacgaacgctgcgtctacagcggccgaaagatcacactagcgaacctaaaagaacaaggcgcactggaaatcgatcacatactcccctactctcgatcctccgacgactcatacatgaacaaggtactcgtcttcactaacgagaaccagaacaaaggaaacaaaacaccctacgaggcattcggcggagactcccagaaatggggcgaaatcgaaagcctagccctccgctccggctaccccaagaaaaaggcaaaacgcattctagacaaaggattcggcgatcgcgaagccggattcaaatcacgcaacatcgtcgacagcggctacatcgcccgactaatcgcaaactacaccaaagaatacttgaagttcctcccgttagactcacacgaaaacaccgcgctaatcgctggagaaaaagactcaaaaatccacgtagaagccgtaaaaggcatgctcacagcaacaatgcgccacttctggggcctaggatctaaaaaccgctatgaacacacccaccacgccatagacgccatcataatcgcgtatatcaacgccgccatgatacaacgcttttcacaattccggcagaaccaagagtcattaaaagcccgcttctacgccaaagaactagcaaaagaagagttcaaaacccaacgcgcgttcttcgaaccgtttagcggcttccgagaacaagtcctcgccaaagtaggccagatcttcgtatccagaccgccccgcaagagggcccgaggcgcgctccacgaagaaacattctactcaatcgacgacaagaaactctccgaaacgtatggcggcaaagaaggggtacaacgagcgctatctctaggaaaaatccgccaaataggcactaaaatcgtcgccaacggccccatggtccgagtcgacatcttcaaacacaagaaatcaggacgtttctacgcagttcccatctacacaatggacttcgcactaggcatcctccccaacaaagccgtcgtcagcggcaaagacaacgaccgcatcatcaaagactggctggaaatggactccaactacgagttctgtttcagcctcttcaaagacgatgtcatcgaagtccagaaaaaggatatggaaaaacccgaactggcatacttcgtcagcctcaacacaagctcagcttccatagctctcgttaagcacgacaacaagttcgaaactctaacatcaaaccaagccaaactgttcagcaacgctaaagaaaacaacgttatcgccgagtccctcggcatccagaatctcaaagtctttaaaaagtacaaagtcagccctctcggcgaaatcaaagaagcgaaatacgaaccccgccagcctatagccctgaaaaccagtcccaagaaacaccgcaaacaaaacaacgcccaatga

SEQ ID NO: 7248 - RNA, 3108 nt, synthetic construct
  misc_feature 1..3108: note = Cas9 variant
  source 1..3108: mol_type = other RNA
atgcgacgccttggcctggatctcggaaccaacagcataggatggtgtctcctggacctcggagacgacggggaacccgtaagcatcttcagaacaggagcccgaatcttctcagacgggcgcgaccccaaatcactgggcagcctaaaagcaacccgacgagaggcacgactaacaagacgacggcgagaccgcttcatccaaagacagaaaaatctgatcaacgcactcgtaaaatacggactcatgcccgcagacgaaatccaaagacaggccctagcctacaaagacccctacccaatacgtaaaaaggccctagacgaagcaatagacccctatgaaatgggcagagcaatctttcacataaaccagagacgggggttcaaaagcaaccgaaagagcgctgacaacgaagcgggagtagtcaaacaaagcatcgcagacttagaaatgaaactgggagaagccggcgcacgaacaataggagagttcctagccgacagacaagcaacaaatgatacggtaagagcacgccgactaagcggaaccaacgcattgtacgagttctatccagaccgatacatgctagaacaggagttcgatacactatgggcaaagcaggcggcattcaacccctcactatacatcgaagcagcgcgagaacggctcaaagaaatcgtattcttccaacgaaagctgaagccacaagaagtaggaagatgcatcttcctcagcgacgaagaccgcatcagcaaggcactcccctcatttcaacgatttcggatctaccaagaactctcaaacctcgcctggattgaccacgacggagtagcacatagaatcaccgcaagcctcgcgctacgggaccacctgttcgacgagctagagcacaaaaagaagctgacattcaaagccatgcgagccatcctcagaaagcaaggtgtagttgactatccggtcggcttcaacctagaaagtgataacagagaccacctgatcggcaacctaacatcctgcataatgagagacgcgaagaaaatgataggaagcgcatgggacagattggatgaagaggagcaagactcgtttatcctaatgctgcaggacgaccaaaaaggcgacgacgaagtccgcagcatcctaacccaacagtacggcctaagcgacgacgtcgcagaagactgcttagatgtgaggctcccagacggacatggctcactatccaagaaagccatcgaccgaatcctaccagtcctaagagaccaaggcctcatatactacgacgcggtgaaagaagctggcctaggcgaggcaaacctatacgacccttacgccgctctctccgacaaactcgactactacggcaaagccctggccggacatgtcatgggcgccagcggcaaattcgaggacagtgacgaaaagcgatacggaacgatcagcaaccccacagtacacatagcgctcaaccaagtacgtgccgtagtgaacgaactcatcagactacacgggaaacccgatgaagtagtaatagagatcggacgcgacctccccatgggcgcagacggcaaaagggaactagaacggttccaaaaagaaggtagagcaaagaacgaaagagcccgcgatgaactcaaaaagctaggacacatagactcgcgtgaatccagacagaagttccaactgtgggagcagctggccaaggaacccgtcgatcggtgctgccccttcacgggtaaaatgatgtcaatatccgacctattctcagacaaagtcgaaatagagcacttactgccatttagcctcacgctcgacgactcgatggccaacaaaacggtctgtttcagacaggcaaacagagacaaaggcaaccgagcacccttcgacgcgttcggcaattcgccagcagggtacgactggcaggaaatactcggcagaagtcaaaacctcccatacgcaaaacgctggcgcttcctccccgacgcaatgaagcgcttcgaagcagacggcggattcctcgaacgacaactcaacgacacgcggtacataagtagatacactaccgaatatataagcacaataatcccgaaaaacaaaatctgggtagtaacgggacggctcacatcattactgagaggcttctggggacttaactcgatcctgagaggacacaacacagacgatggcacacccgcgaaaaagagccgagacgaccaccgccaccatgccatcgacgcaatagttgtaggcatgaccagccgtggactcctccaaaaagtcagcaaggccgcaagaagaagcgaagacctcgacttaacccgattattcgaaggacggatcgatccctgggatggcttccgggacgaagtcaagaagcacatagacgccatcatcgtcagtcaccgcccaagaaagaaatcccaaggagcactacacaacgacaccgcatacgggatagtagaacacgccgaaaacggggcatcgaccgttgtacacagagtccccatcacctccctcggaaaacaaagcgacatcgaaaaagtccgcgatccgctaatcaaaagcgccctcctcaacgaaaccgcgggcctaagcggaaaaagtttcgaaaacgccgtgcaaaaatggtgcgcagacaactccatcaaatccttacgcatagtcgaaaccgtcagtatcataccaataacggacaaagaaggcgtagcctacaaaggatacaagggagatggcaacgcatacatggatatatatcaagaccccactagctcaaagtggaagggggaaattgtatcaagattcgacgctaatcagaaaggcttcataccctcatggcaatcacagttcccaacagcgagactcatcatgcgcctccgtatcaacgacctattgaaactccaagacggagaaattgaagaaatataccgcgtacagcgcctaagtggatccaaaatactaatggcaccccacacagaggccaacgtcgacgcacgagacagggacaagaacgacaccttcaaactgaccagcaagtcgccaggaaaacttcaatctgcaagcgcacgaaaagtccacatctcaccaacaggtctcataagagaaggatga

SEQ ID NO: 7249 - RNA, 3108 nt, synthetic construct
  misc_feature 1..3108: note = Cas9 variant
  source 1..3108: mol_type = other RNA
atggaacaactgaactacatcctcggcctcgacatcgggatagcatcagtaggatgggccgtagtcgaaatcgaccacaacgaagacccgattaggctcatagacgtcggcgttcgcaccttcaacaaggcggaagtagcgaaaacaggcgaatcacttagcctaatccgaagactagcccgaggaagccgtcgactcgtcaggcgcaaaaagatgcgcctactaacggccaagcgcttactaaaatcagaaggcattctttccgacctcgacttcaacaagggcgccatcctaaacctgcccaacaactgctgggaactccgggtcaaaggactcgacaagaaactaagcgataaagaatgggctgccgtcctactccacataataaaacatcgaggatacctctcccaacggaaacacgaccggaaaacagacgacaaagaactaggagcactcctatctggcgtgagcaagaaccactctctcctcgaagaaggagagttccggactgccgcagaacttgccatcaacgtattctgcaactccaaagggcacataagaaaccaatggggcgactacagccacacattcagcagactagacctgcaaaaagaaataaaacagctgttcgtcagccaaagggaactggggaacccgtacaccagttcctccttcgaagaaaacatcatcagcctgctcatgaaacaaaaagaagcaataagcggcaacgacatactaaaaatgctcggaaaatgcacgtacgaaaagaacgaatacaaagctgccaaaaacacatacagtgcggagcgctttgtatggctaactaaactcaacaacctcagaatagtggacgatggcgtcgagcgcgccctaaatagctcagaacgaaaactactaatcgatgaaccctacaagaaagcaaaactaacctacgcgcaagtccgaaaaatcctcgagctccccgacagcgcggtcttcaaaggagtacgctacttcgcagacaacgcagaaagtagcactctgatggaaatgaaattctggcacagcatccggaaagcactcgaatcaaataacctcaaagacgaatggctagtactaaaaaccaaacccgaactcctagacgagatcggaacgggcttcagcatctacaaaaccgacgacgacataaccagttacctcagcaacaaactcgacaagaaagtcctcgacatcctgctagtcgaagtcagcttcgacaaattcatcgagctcagcctcaaatgcctccgcaaaatcataccactcatggagaagggctaccgctatgatgaggcctacaaatatatatacggcgaagtcaacatcgaatacaacctaaacgacatcaagaacccggtcgtcctaaggtccttctcacagtcccggaaagttataaacgcagtcatccgcctctacggcagtcccgcacgaatccacatagaaacggccagggacatcggcaagagcttcaaagaacgcaaggccatcgagaagcagcaagagaaaaacagactagaaaaagtccgcgcggccgaacactttaaacaactcttccccaactacgtaggagaacccaaagccaaggatattctcaaagtgcgattatatgaacaacagcaaggcaagtgcctatacagtggcaaaatactagacataaaacgcctcatggaacacggctatgtagagatcgaccacgccctccccttctcacggacttgggacgactcatttaataacaaagtgctagtcctcgccaacgaaaaccaaaacaaggggaataaaacaccatacgagtggttcaacggcaaagacaattcggacagctggaaacgattcctcgccctcgtaaacaatagtgggttctccgctgtgaagaaacaacacatcctaatgaaagaaattgacgaagaaggattcaaacaaaggaacctaaacgacacgaggtatattacccgcttcctatgcaactgggtagagaacaacatacccctcctcggcaaaggtgtgaaacgtgtgttcgcaccacagggaaagataaccgcccttctacgctcgaactggggcatacggaaggtacgcgaggacaacgaccgacaccacgcaatcgatgcaatcgtcgtcgcatgcaccacggtaagcatacagcagcggattacaaattacgtcaaaaactcagaaatcaaccgcaagatcaaacgacagaactacctaaaattccccgaaccctggaagttcttccgcgaggacatctcgatccgtgtattcagcaacaacccaatagaagaactgaagcaacaactcagcgatcgaccagaggctaaccaccaattcgtgaccccactcttcgtaagccgcgcccccgtcagaaaaatgactggacaagggcacgaggacaccatcagaagcgcaaaacgaatctccgaagggatttcagtcctccgagtaccactcaccaaactgaacgacaaaagcctagaactgatggtcaaccgcgaacgagagaaggagctatacgacgcactcaaacaacgactactcgagttcaagaacgatccagaaaaggccttcgcagaaccattctacaaaaagggcgggcaacaagtcaagaccgtcaggatcgaacgcgtccagaagaacggagtcctcgtgaacaacaacaccggaatagcagacaacggaaacatcgtacgagtcgacgtgttcctcaaaaagaagaaatacttcctcgtgccaatatacagctggcaagtggcaaaaggcatactcccgaacaaagccatagtcgcccacaaaaacgaatgcgactgggcagacatggacggcagtgcccagttcctcttctctctctacaccaacgacctcattgaagtagtacttaaggactcgacgatactcggctacttcagttcgatcgacagagccaccgcggccatcatcatcaaagaaccagacatggagaaaagcaagggaaaggaaggaatccaccgagtcggcgtgaaaaccgccaggagcttcataaaatacaacgtagatgtccttggtaaaaacatatcccgatgcagaaaagccaaacgcctaccagtccgctga

SEQ ID NO: 7250 - RNA, 3108 nt, synthetic construct
  misc_feature 1..3108: note = Cas9 variant
  source 1..3108: mol_type = other RNA
atgctccgcaagatgcactaccgcctagccctagacctcggcagtacgtcactcggctgggcaatgataagactaaacgcaggcaacgagccctgcgccgtaatcaaagccggagtccgcatatttagcaacggaagaaaccccaaagacggttcaagccttgccgtaacccgcagggaggcccgagccatgcgccgacgaagagaccgactcctcaaacgcaaagcacgaatgatccaaaccctaatagaatacggcttcttccccgccaaagaagaccaaagaaaagccctcgaaatcatgaacccctttgccctacgagccaaaggactaaatgaggcactgactcccgccgagttcgcccgagcactcttccacataaaccagagacgaggatttaaaagtaataggaagacggataagaaagacaacgacagcggtgccctcaagaccgctatcaacaaactacgcgaaaccttgaaaacagaaaactgcaggaccgtaggagaatggctcaacaaacgagatgtagcaggactcactgtccgagcacgataccaccaagacaagacaataaaagaggacggaaaaagcaaaataaacaaatactacgacctctacatcgaccgcgcgatgatcgaacacgagtttgacgagctctggaagaaacaagccgaattaaacccgaccctgtttacagaagcagccagggcagacctcaaagacgtacttctgcaccagcgagcgctgaaaccagtgaaacccggacgctgcacattcatgccagacgaagaacgcgcacccctcgccttgccctcaacccaacgttttaggatgtaccaggaagtaaacaacttacgaatactccgcgacggcctaaaagaagagagcctgaccctgaaccagagagacgacctgatagccgcactagaagagaacaacaaacgcacattcacccaaataaagaagctcttgggactgggaggcgtcgtcaaattcaacttcgaagaccccaaacgcgaagaacttaaaggcaacaccacatccgcgatcctcggaaaggacgagcacttcggctccgtatggttcaaattcgacgaagcaaaacaagacgccatcgtaatgcaacttttcaaagaggaaaacgaagcaaaactgctgagatggctccaaaacgaaacaggaatagatgaaaagagagccgagacaatcgcaaacgtcggcctaccagaaggctacggcagcctatgcgccttagccctcgcgcgcatccttccagaactcagacgagacgtcgtaccatacagcgacgcagccaaggcagcaggcttccaccactccgacaccagcaacaaccaggaagtccccggactaacgttcccaatagagctagtcgtaactgaaacaggagagataaaaactaagcacatctttcacgaactcccctactacggcgaatacctgcaacgtcacgtaggcttcggtagcggtaagccagaggactccgctgaaaaacgctacggaaaaatcgcaaacccaacagtacatatcggactaaaccaagtcagactcgtcgtaaacaccctgatcaaacgctacggacacccatcagaagtaatcgtagaggtagcgcgggacctcaaacagtccaaagatctacgtgacgaagaaggaaagcgacaggccgagaaccaaaaacgaaacaaaagaatcagaactgcgatcgcaggggtcctccagacgagcgaggagagagtccgacgcgacgacatcgagaaaatgatcctctgggaagagttatcattcgaccccgccgaccgacggtgcccatacagcggagtccagatcagcgcagcgatgctactgtccgacgaagtcgaaatcgaacacatcctcccgttctcccagaccctagacgacagcctaaacaataaaaccgtcgcgctccgccaagcaaacagggtcaaaggaaaccgaacaccctgggaagcgttcggcgcccaaagcaccgcaggatttgactacgccacaatactcgcccgcgccgaacacatgccaaaaggcaaacgataccgattcgccgaagacggctaccaacgatggctaaaggatgacgcaggattcctaccacgcgccttaaacgacaccaggcacatgagcaaagtagcacgcgaatacatgagtctaatctgccccaacacacgggtaatccccggacgaatgaccgcaatgctacgcggcaaattcgggctaaacgatgtcctaggactcaacggagagaaaaaccgaaacgaccacagacaccacgcagtcgacgcgtgcgtgatagcagtcacagatcaaggactcctgcaacgattcgcaaaagcctccgcatctgcaagggaacaacagcttaatagactcgtcgaaaatatgcccctaccctgggaatcataccgggaacacgtggagagagcaatagatgcgatctgggtctcccacaaacccgaccacagccacgagggcgcaatgcacaacgacacggcctatggtctcttgggagacgggaaggtctcgatccacaaaatggtggaggggaagcgcgaacgcatagaagaaagcctaaaagtcatcgcattcacaaatgcaaaagcaaatgatcgccacggcttgcttgacaatggcgaaccaagaccctacaaaggatacaaaggagactcaaactactgtatcgaaatcataaggaacgagaaaggcaaatgggaaggagaggtaataagtaccttcgacgcataccagctggtacgtgaacacggggtggcacgactccgacaccccacactaagcgttagcggcaagcctctcgtaatgcgtctaatgaaagacgagacaatacgcatggtaactaacgaaaagccaatcaccgcaagagtatgctgggtgcgctcagacacccgcatcgcatttgccagcacctccgaagccaacgtagacgcgcgcgacagagacaaaaacgacagcttctcatacattgtgaaaacagcatcagtactccaaaaactccaggcaagaagaatttcaatcagcccaaccggcgaactccgggacccgggattcaaagaatga

SEQ ID NO: 7251 - RNA, 3108 nt, synthetic construct
  misc_feature 1..3108: note = Cas9 variant
  source 1..3108: mol_type = other RNA
atggaacagttgaattacatcctcggcctggacatcgggatcgccagcgtgggctgggccgtcgtggagatcgaccacaacgaggatcccatccgcttaatcgacgttggagtacggaccttcaataaggcggaggtggccaagaccggcgagtccttgagcctgatccgccggctggcccgcgggtcccgtcgcctggtgcggcgcaagaagatgcgtctgctgacggccaagcgcctcctcaagagcgagggcatcctgtctgacctcgacttcaataagggcgcgatcctgaacctgccgaacaactgctgggagctccgggtcaaggggctggacaaaaagctaagcgacaaggagtgggcggccgtgctcctgcacatcataaagcatcgcggctacctgtcccaacggaagcacgaccgcaagaccgacgacaaggagctcggagccctgctgagcggcgtgtccaagaaccatagcctactggaggagggggagtttcggaccgccgcggagttagccatcaacgtcttctgcaactccaagggccacatcaggaaccagtggggcgactacagccacactttttcccggctcgacctgcagaaagagatcaagcagctgttcgtgagccagcgcgagctagggaacccgtacacatcttcaagtttcgaggagaacatcatcagcctgctgatgaagcagaaggaggccatttccgggaacgacatactcaagatgctgggtaagtgcacatacgagaagaacgagtacaaggccgccaagaacacctactctgcggagcggttcgtgtggctgactaagctcaacaacctccgcatcgttgacgacggcgtggagcgggccctgaacagcagcgagcgcaagctcctgatcgacgagccctacaagaaagcgaagctgacgtacgcgcaagtgcgcaagatactcgagttacccgacagcgcggtcttcaaaggcgtgcggtacttcgcggacaacgccgagagcagcaccctgatggagatgaagttctggcactccatccgcaaggccctcgaaagcaacaacctgaaggacgagtggctggtgctcaagactaagccggagctgctggacgaaattgggaccggtttctccatctacaagacggacgacgacatcacaagctacctgtcaaacaagctcgataagaaggtcctggacatcctgctcgtggaggtgagcttcgacaagttcatagagctgagtctgaagtgcctgcggaagatcatacccctgatggagaagggctaccgctacgacgaggcctacaagtacatttatggtgaggtcaacatcgagtataacctgaacgacatcaagaatcccgtggtgctccgtagcttctcccagagccgcaaagtgatcaacgcagtgatacggctgtacgggtcccccgcgcgcatccatatagagaccgcccgggacatcggcaagagcttcaaggagcgcaaggccatcgagaagcagcaggagaagaaccggctggaaaaagtcagagccgcagagcacttcaagcagctgttcccgaactacgtaggcgagcccaaggcgaaggatatccttaaggtgcggttgtacgagcagcaacaggggaagtgcttatattccggcaagatcctggacatcaagcgcctaatggagcatgggtacgtcgaaatcgatcacgcgctccccttctcgcgaacgtgggacgactccttcaacaacaaagttctggtgcttgccaacgagaaccagaacaagggtaacaagacgccatacgagtggttcaacgggaaggataacagcgacagctggaaacgcttcctcgccttagttaacaacagcggcttcagcgcggtgaagaagcaacacatcctgatgaaggagatcgacgaggagggcttcaagcagcgtaacctcaacgacacccgctacatcacaaggttcctgtgtaattgggtggagaacaacatcccgttgctcgggaagggtgttaagcgcgtgttcgcgccccaggggaagatcaccgccctgctgcgctccaactggggcatacggaaggtgagggaagacaacgatcggcaccacgccattgacgccatcgtcgtggcctgcacgaccgtgagcatccagcagcgcatcaccaactacgtcaaaaactccgagataaaccggaaaatcaaacgccagaattatctcaagttcccggagccctggaagttcttccgggaggacatcagcatccgcgtgttctccaacaacccgatcgaggaactgaagcagcagctgagcgatagacccgaggcgaaccaccagttcgtgacgcccctcttcgtctcacgcgcccccgtgcggaagatgaccgggcagggccacgaggacaccatccgctcagccaagcggatctccgagggcatcagcgtgctgcgcgtcccgctgacgaagctcaacgacaagtccctggagctaatggttaaccgggagagagagaaggaactctacgacgccctgaagcagcggctactcgagttcaaaaacgaccccgagaaagcgttcgccgagcccttctacaagaagggcgggcagcaggtcaagacggtccgcatcgagcgggttcagaagaacggggtcttggtcaacaacaacacggggatcgccgacaacggcaacatcgtgcgcgtggacgtcttcctgaagaagaagaagtacttcctcgtacccatctacagctggcaggtcgccaaggggatattgccaaacaaggcgatcgtggcccacaagaacgagtgcgactgggccgacatggacgggtccgcccagttcctgttcagcctctacaccaacgacctgatcgaggtggtgctgaaggactccactatcctcgggtacttcagcagcatcgacagagccaccgcggccctgataatcaaggagcccgacatggagaagtccaagggcaaggaggggatccatcgcgtcggcgtgaagacggcccgcagcttcatcaagtacaacgtcgacgtcctgggcaagaacatctcccgctgccgcaaggcgaagcggctccccgtgaggtga

SEQ ID NO: 7252 - RNA, 3111 nt, synthetic construct
  misc_feature 1..3111: note = Cas9 variant
  source 1..3111: mol_type = other RNA
atgcgcatattcgggttcgacataggcataaccagtatcgggtgggcatacgtagaaagcaatgagctcaaggactgcggcgttcggatattcacaaaagccgaaaacccgaagaacggcaaaagcctagccctaccccgccgggaagcacgcggcgctcgacgacggctagcaaggcggaaggcccgcctcaacgccataaagcgcctcctatgcaaggagttcggcctcaacgtcagcgactacttcgcgaacgacggggaactgcccaaagcatacgaaaccaccaaagacaccaaaagcccatacgagttgcgatccctcgcactcgaacagaaactagaacccaaggaactggccagggtcatactccacatagcaaaacaccgcggctacggcaacaaacacgccaaaaccggcagtgacaaggacagcggcaaagtcctctcagccataaaagtaaatgaaacggccatgaaggacaaataccagagcgtaggggagtacctttacaaagaattctaccagaaactccgcctagagagcgaaaaaaaaggcaataacatcacaaaagaattcaaaaacgtacgcaacaaaggcgaaaactacgaacactgcgttgcccaggaacaagtccgagcggaactcgagctaatattcgccaagcaaaaagacttcggcgccaccttcagcgaaaacttcgaatcccaaatcatagaaactgcgttctaccaacgtgacctaaaatcattcgaagataaagtcggcaaatgcgtcttctacgaaaacgaaaaccgagcacctaaagactccctgtcagccatggaattcgtcgccctcaccagaataataaacacactgaagaacttagaagaaaaatcaaagaaccttggcataggcgaagtctacggcaaagacaaaatccaagaaattcttaaaatcgtgctcgacaagggagaaatgtcctacaagaaactccgcgagatcctccatttagacgaacacatcctcttcgcgaaggattccaaactcgactacacgcaaggcgtgcaagaagcagaaaaggcaaaattcatcgaactcaaaaacctcaaggccttcaaaaaagcaatggggggcgacttctccaactttgcaagggaagaactcgacaaaatcgccaccgacatcacactagtcaaatccaaagaaaatcttgcaaaaaaactccaaaactactctgcccttagcaaggagcaagtcgaggcgctcagcaacctaagcttcgccaaacacatcgacctcagcctcaaggcactcgaacaaatcctaccattcatgcgaggggacaaaaccggaaaatgcctacggtacgacgaggcagtaaaaaaagccgagctccaggagcacagaaagcacaaacagaagggcgagttcctcatccccctaaaagactacgaaccctacctagccaacccagtagtcgcccgtgccctctccgaataccgaaaggtcctgaacgccctactgcgcaaatacggaaaagtccacaaaatccacctcgaattcacccgcgaggccaaactctcagcgaaagagcgccaaaaatacgagaaggagcaaaaagaacacttcgaagctaaccaaagagctatacaacagtgcgaaatacttggcctacccatcaacggcacgaacatcttaaaaatgaaactatggctggaacaaggtgaatgctgcgcctactcgggggagaaaatcacgagggaacacctactagacagcaacgctctacaggtcgatcacatctacccatactcaagatctttcgacgactcgtacatgaacaaagtactcgtcttcgccaaagaaaaccaggacaagggcaacaaaaccccattcgaagcatttggaggcgacaaagagaaatgggaccgcatattaagtctcagcgccaaactcccgaagcaaaaacagcggcggatctccaacaccaactttaaggacaaagaaggaggcttcctagcacgaaacctgaacgatacgggctacattgcgaaactcgcaagccagtggaccaaagactgcctcgaattcgaggacttacgagaaaacgaagtcacaatagcgggcgagaaaggatcgtcagtccacatcgaagtcgttagcggacaactaactagcatgctacgccactactggggcctcggcaacaaggaccgcaacaaccacctgcaccacgcagtagacgccgtgatcttagcttacacaaacaacgcaatgataaaggcattcgcgaactttaggaagaaccaagaagaaaataaaaaaaagttctacgccaagcaaatcgcagaaagcgagtacaaagccaaaaaagccttcttcgaaccatgcaaaaacttccgacaaagagtcgaagagaaaatcaaggaaatcttcgtctcgaagcccccaaggaaacgcgtccgaggcgccctccaccaagagacattctacccgttcgaaaaactatgcaacgacaaagaatactcagagaagttaaaaatggactacggcggtgaaaagggcatgcagaaagcaatcgccctcggtaaaattagacaaataggaactaagatagtcagcaacggagcaatggtacgtgtcgacatcttcaaagacaagaaaggaaaattctacgccgtaccaatctatacaatggacttcgccctgggcatactacccaacaaagcagtggcgatcggaaaagacaaagacggagtcatcaaagactggatcgaaatggattccaactacgacttctgtttctcgttgttcaaagacgacctcatactcgtccaaaaaaaagaaatggaaagggcagaactatgctatttcgtttccttcggaagcacaaatgcgcaaatcaacgtcgagaagcacaataacaaattcgagggcctcagcgagaacgaaaaaatattgtactccaacgcaacgcagaaggaagtagcaggaaaaagcataggaatacaaaacctaaaaacattcgagaaataccaagtctcacccctcggagaagtacaaaaggcagaattcgaacctcaccaagagatcaaactaaaaagcagcccaaaaagaaaggactga

SEQ ID NO: 7253 - RNA, 3111 nt, synthetic construct
  misc_feature 1..3111: note = Cas9 variant
  source 1..3111: mol_type = other RNA
atgctacacaaaatgcattacagactggcactggacttaggcagcacttccctcggatgggcaatgatcagactagacgccgacaaccagccgtgcgccgtcataaaagcgggggtccgcatattctcgaacggaagaaacccaaaagacgggagctcgctcgcagtcactaggcgggaagcgagggcaatgagaagacgacgcgaccgactcctaaagcgaaaggcacgaatgatgaggacgctaatagaatacggcttcttcccggccgaggccgcacaaaggaaagcactcgaaacaatcaaccccttcgctctacgcgccaagggcctagacgaggccctgacaccagccgagtttggaagggcactcttccacataaaccaacgacgcggattcaaaagcaaccgcaaaaccgacaaaaaggataacgattccggggccctaaagaccgccatcggaaaggtccgcgcaactatagaggcagaaggctgccgaaccgtaggagagtggctgcacaagcgagacgttgccggactaactgtcagggccaggtaccaccaagataaggtaataaaggaggacgggaagacgaaaatagacaaatattacgatctctacatagaccgggcaatgatagagcaagagttcgatgaactatggaagaaacaggccgaactaaaccctgccctgttcacggaagcagcacgagcggatttaaaagacgtcctactccaccaacgaccgctaaaaccagtcaaaagcggccgctgcacattcatgcccgacgaagaaagagctcccctggcactacccagcacacagcgatttcgaatgtatcaagaagtgaacaacctccgcatacttcgcgacggcttaaaagaggaaccattaacactaaagcaacgagacgacttaatagctgcactcgagaaaaattcaaaacacagcttcacacaaataaaaacattactaggcgtcggaggagcagtgcaatttaacttcgaagacctaaaaagacaagaactgaaaggaaacactacaagtgccatactaagtaacgacaagcacttcggaaaagcctggttcacattcgatgaagccaaacaggacgctatcgtactgcagctagtaaaagaggaaaacgaggccaaactcgtacgatggctacaagacgaaaccggcatagacgaaaaacgagcagaagcaatcgcaaacgtcggactaccggaagggtacggatcactatgcgcaaaagccctagcacggatactaccagagctccgcagggacgtaatgacctacgataaggcagtacaagccgcgggcttcgaacaccatagcaggctgggcagcaacacagaaatcccaggcctgaccttcaaaatcgaaagcatagaccaagacagcggagaagtcaagcagttccatatccacaaagtactgccctactacggggagtacctccaacgccacgtagggttcggctccggcgagccagaggaccccgcggagaagcgatacggaaaaatagcaaatccaaccgttcacatagggctaaaccaaatacggctcgtcgtaaatgcactcctaaaacggtacggacatccgtcagaagttatagttgagttagcgagggatttgaaacaaagcaaagaccaaagagatgaagagtcgaaacgacaagccgaaaatcagaaacggaacaagaggctgcgcgacgccatcgcaggcaccctaaaaatcagcgaagaacgcgtaagacgagacgacatacagaaaatgatcctctgggaagaactaagttttgatcccgccgacaggcgctgcccgtacagcggcgcacaaataagcgcgaccatgttactaagcgacgaagtcgaagtcgaacatatactaccattcagccaaaccctagacgacagcctaaacaacaaaacggtcgccctgcgacaagcgaaccgaatcaaaggaaaccgcacaccgtgggacgccttcggagcgcaagccgtagcaggattcgactacgaatcaatactggtacgagcagagggcatgcccaaagcaaagaggtatcggttcgccgaaaacgggtaccaacgatggcttaaggacgacgccagcttcctcgctcgcgcgctgaacgacacgcgacacatgagtaaagtagccttcgagtacttaaaactcatatgcccgaatacgcgagtaatacccggacgaatgacagcgatgctgagagcaaagttcggcctcaacgacgtactaggactaaatggcgagaaaaacaggaacgatcacagacaccacgccgtcgacgcctgcgtcatagcagtcacggaccaaggactgctgcaacgattcgcaaaagcctcagcgtccgcgcgagaacaacaactcaaccgtctggtagaaaatatgccactcccgtggggatcatacagagaacacgtgcaacgggcgatcaacgcaatctggatctcgcataaacccgaccacagtcacgaaggcgcaatgcacaacgacacggcgtacggcctccgaggcgacggcaaggtgagcttccacaaaatggttgaaggcgtccgcacacacagcgaagacaacttaaaagtcatagaaatcagcaacgctaaggccacagacagacacgggctcctcccgaacggcgaacccagaccctacaaagggtacaaaggagacagcaactactgcatagaaatcgtcaggaacgaaaagggcaaatgggagggagaagtcatatcgacattcgaagcctaccagctggttcgagagcacggaatcgcaagacttcgacacagcacgctgtcagtttccggcaaactgctagtcatgcgactcatgatagacgacgtcgtcagactaataatcgacgaacaaacaagaaccatgaggatagccacgctaagcggcaacggacagatcttcatggcggacacaagtgaagccaacgtggacgcacgaaaccgaagcaaggaagaaacattcgcctacgtttcaaaaatggccggtagcctccagaaggccaacgcccggagaataaacatatcaccaatcggagaactccgagacccaggcttcaaggaatga

SEQ ID NO: 7254 - RNA, 3114 nt, synthetic construct
  misc_feature 1..3114: note = Cas9 variant
  source 1..3114: mol_type = other RNA
atggagcgaatcttcggattcgacatcggaaccacgagcatcggatttagcgtaattgattactcgagtacacaaagcgcggggaacatccaaagattaggagtaagaatattccccgaagccagggacccagacggaaccccgctcaaccagcagcgacgccagaaaagaatgatgagacgacaactccggcggagacgcatacgcagaaaagcgctcaacgaaacactacacgaggcgggtttcctaccagcatacggatcggcggattggcccgttgtgatggcagacgaaccatacgagctccgcagaagaggactagaggagggactaagcgcatatgagttcggcagagcaatataccacttagcacaacaccgacacttcaaaggccgagaactggaagaaagtgacacacccgacccagacgtagacgacgaaaaagaagcggccaacgaaagggccgcaacgttaaaagcactcaagaacgaacaaacaacactcggagcgtggctagcgaggcgcccaccctcagaccgaaaacggggaatacatgcgcatagaaacgtcgtagcggaagagttcgaaaggctatgggaagtccagtcaaaattccacccagccctgaaaagtgaagaaatgagagcaagaataagcgacacgatattcgcgcagaggccagtgttctggcgcaaaaacacgctcggagaatgcagattcatgcccggcgagccgttatgcccaaaaggtagctggctatcccaacagagacggatgctcgaaaagctaaacaacctcgcaatagccggcggaaacgcacgcccactagacgctgaggaacgggacgccatactcagtaaactgcagcaacaagcgtcaatgagttggccaggtgtcaggagcgccctcaaagccctgtacaaacaacgcggagagccaggggcagagaaaagtctaaaattcaacctcgaactaggcggggaaagcaagctactcgggaatgccctcgaagccaagctcgccgacatgttcggaccggactggcccgcgcatccaagaaaacaagaaataaggcacgcagtccacgaacgactctgggcagctgactacggagaaacccccgacaaaaagagagtcataatcctttccgaaaaagaccgaaaggcacaccgcgaagcggcggcaaacagtttcgtagccgactttggcataacaggagaacaagccgcacaattacaagcgctgaaattacccacgggatgggaaccctacagcataccagccctcaacctattcctagcagaactggaaaaaggcgaaaggttcggcgcgctagtaaacgggccagactgggaaggatggagaaggaccaacttcccacacagaaaccagcccacaggcgagattctagacaaattacccagcccagcaagcaaggaagagagggaaaggatcagccaactcagaaatccaaccgtagtaagaacccaaaacgaattacgcaaagtggtgaacaacctaatcggactgtacgggaaacctgacagaatccgcatagaggtaggaagagacgtaggcaagagcaagagagaacgggaagagatacaaagcggcatcagacgaaacgagaaacaaaggaagaaagcgacggaagacctcattaaaaacggcatagccaatcctagcagagacgatgtagaaaaatggatactctggaaagagggacaagaacgatgcccctacacaggggaccaaataggattcaacgcactcttccgggaaggcagatacgaggtagaacatatatggccgagatcacgcagcttcgataactcaccccgaaacaaaacactgtgccgaaaagacgtaaacatcgagaagggcaaccgaatgccgtttgaggcgttcggacacgatgaagaccgctggtcggccatacaaatccgcctccaaggaatggtgagcgcgaaaggcggcacaggaatgtccccaggcaaggtcaaacgattcctcgccaaaaccatgccagaagacttcgcagcaagacaactaaacgacacaagatacgcggccaaacaaatactcgcacaactaaagagactatggccggacatggggcccgaagccccagtgaaagtagaagcagtcacagggcaggtaacagcgcaactgagaaaactatggacactgaacaacatccttgctgatgacggagagaaaacccgcgccgaccaccgacaccacgctatcgacgcccttacggtcgcatgtacgcacccggggatgaccaacaaactgagtcggtactggcaactaagagacgacccacgagccgaaaagccagcactgacaccaccgtgggacaccatcagagcggacgcggaaaaagccgtaagcgagatcgtggtatcacatagggtgcggaaaaaggtcagcggtccgctccacaaggaaactacatacggggacacgggaaccgacataaaaaccaaatcaggaacgtaccggcaattcgtgacacgcaagaaaatagaaagcctctccaaaggcgaattggacgagatccgagacccgcgaatcaaagagatagtggcagcccacgtggcaggccgcggcggcgaccccaaaaaggcatttccaccatacccatgcgtcagcccaggcggaccagaaatccgtaaagtccgactaacaagcaaacaacaactaaaccttatggcacaaacaggcaacggatacgcagacttaggctcaaaccatcacatagcaatataccggctaccagacggcaaagcagactttgagatcgtcagtctcttcgacgcgagtagacgactagcccagcgcaacccgatagtacaacgtacgagagcagacggcgcctccttcgtgatgagcctagcagcaggggaggcgataatgattccggaaggaagcaagaaaggaatctggatagtacagggggtctgggcatccggacaggtagtgctcgaacgggacacggacgccgaccactcgaccacaacacgccctatgccaaaccccatactcaaagacgacgcaaagaaagtaagcatagacccgatcggacgagtgcgcccaagcaacgactga

SEQ ID NO: 7255 - RNA, 3117 nt, synthetic construct
  misc_feature 1..3117: note = Cas9 variant
  source 1..3117: mol_type = other RNA
atggcaaaacaagtcagatatcgcctaagcctagaccttggctccaccagtctaggctgggctatattccgcttagacgccgacgcccaccctacagccattatcaaggcaggcgtacgaatcttctccgacggacgaaacgcaaaagacggctcctccctagcagtaacccgcagagctgcacgctccatgcgccgccgacgagaccgactactgcgtcgaaaaacccgcatgctcgacgccctccttgaatacgggttcttcccccaggacgctgcgcaacgaaaagccctcgaaaggctaaacccctacgcactaagagcagaaggacttgcccggccacttacccccggagagttcgcaagggcaatcttccatctcaaccaaagaagaggctttaaaagcaaccgtaaaacagacaaaaacgacaacgacagcggagcactgaagactgcaacatcacagctccgacaagacatccaggcgagcgggtgcagaacagtgggagaatggctgtggacacaacgcctccaaaagaaaccggaaggcgtaccacaccagggagtgcgagcccgataccgcgaaacaccacacatcaactccgaaggaaagaaacgcatcgaaaagaaatacgacctgtacatagataggtcgatgatcgaagccgagttcgacgccctgtggagcgcccaagcaacattcaaccccgtagtcttccacgcaaccgcacacgaaaaactcaaagacatcctcctctaccaacgcccactgcggccggtaaaaccgggaagatgcacactcctacccgaagaagaacgagccccactagccctacccagcacccaaaggttcagaatctaccaggaacttaacaacctacggctacttgtcgatcaactaaacgaacaacccctaacacttgcccaaagagacactatcgcaacacttatggaaggccgcgccaaaataagtttcgaccagatccgcaaagcactaaaactaggaagcatgaccaaattcaacctcgaggacgacaaacgcaacgaactcaaaggcaacgccacgggaagccaattagcaaagaaagagttcttcggcccagcctggcaccaattcgatgaagcactacaagacgacatcgtctggcacctcctatctgaagaaaacgaaagcgccctcatctcttggctccaagaccgtacgggaatcgacgccgccaccgcgcaagccgtatccaacgcctcactgccagaagggtacggctccctatcaaggaaagcactagaagtgatactaccgcgactacgctccgaagtaatcacctatgacaaagcagtacaggcagccggatttagccaccactcccaactggggttcgagtatgaccccgacgatgtcgaagactggatcgaccacgccaccggagaagtgaaacccatattcaaaagactaccatactacggaaaagcacttcaaagacatgtagccttcggatcaggaaagccagaggactcacaagaaaaacgatatggaaaaatcgcgaaccccacggtccacataggtctaaaccaagtacgagtcgtcgcaaatgcactcatcgcgcgctacggacgccccaccgaaataatcatagaactagcccgggatctaaaacagagccgggaacaacggcaacaagaccaacgaagacaagctgacaaccaaaaacgcaacgcacggatcaggaactcaatagcccaagcactcgggatcgcagaagcccgagtaagacgcgaagacatacaaaaatggatactctgggaagaactcgacccaggcgacgccatgcatcgctgctgcccctactcgggagtccccataagcgcaagcatgctcctctccgagcaggttgaaattgaacacatactgcccttctcgatgacactggatgactcactaaacaaccggaccgtatcactgcggcaagccaatcgcatcaaacgcaaccgatctccgtgggacgcccgcgaggacttcgaagcccagggatggcactatgacggcatcctacaacgtgccggcttaatgcctgttcaaaaacgctaccggttcgccgccgacggataccaaagatggctccgagacgaccaagacttcttggcccgagccctcaacgacacacgctacctcagccgaatagcggcggagtacctcaggctcgtctgcccacaaggaaccagggtaatacccggccaactaaccgcactactacgacgccgcttcggtctcaatgacatcctaggcctagagggcgagaaaaacagaaatgaccaccgccaccacgccgtcgacgcctgcgtaatcggaataaccgaccacgggctcatgcaaaggttcgcacgggcctccgcgcaagcgcgggaacaaggcctcacacgactcgccgaagaaatgccactaccatggccaacataccgcgaccacgtcgatcgggccgtgtcactaatctgggtatctcacaaacccgaccacgggcacgaaggagcaatgatggaagaaacagcgtacggactaatgaaagacggcaccatcagacaacgacacaaagccgacggaacgaagggtagggaagtagcaaatgtcattcgcattgccgaaccggcacaaccgacccgacacggcgtcgacgaccaggggcgaccactgccatacaaaggatacataggcggcagcaactactgtatcgaaataaccagaggcgcgcaaggcaaatgggaaggcacggtaataagcacatccgatgcatacggcatcgtccgagcacgtggcatagcagggctacgcaacacatcccagggacaaaacggacatcccctagtaatgcggctcgtgataggcgactccctacgactacgaataaacgacgcgttacaaaccatgcgcgtcacaaaaatcagcggaaatgggcaagtgttcatggccggtgtgcacgaagccaacgtcgacgcgcggaatagagacaaatcccaagcatttgccctagtctccaaaatggccgggtcactccaagcagcccaggcacgccaagccaccatctcgccaataggagaaatacgagaccccggcttccccgggtga

SEQ ID NO: 7256 - RNA, 3120 nt, synthetic construct; identical to SEQ ID NO: 1456
  misc_feature 1..3120: note = Cas9 variant
  source 1..3120: mol_type = other RNA

SEQ ID NO: 7257 - RNA, 3123 nt, synthetic construct
  misc_feature 1..3123: note = Cas9 variant
  source 1..3123: mol_type = other RNA
atggacagacgggatgcgcgagctatgcgacgccgccgagaccgattccaacaaaggcaaagagcattactaaaatacctagttgcagacggactattcccagaagacgaaggggaaaggaaagcactggcggccctagacccctacgcactaagggcaagggccctagacgaagccctgagcctgcacgaacttgggcgcgcactcttccacctcaaccaacgaaggggattcaaaagcaacagaaaggctgacagaaaagccgacgatgatgccggcaaaatcgcgataggggtagaccgagcacgggaggcaatggccgaaaacggggcccgaacatacggagagtggctacacaggagaagggcgagcgcgacagacgcaaacgccatcccacccgtgaggacgcgactgagacccgaatcgggagaagacgcaaagggagacggctacgacttctaccccggcagagacctactggaggaagagttcgccgcaatctgggaagcacaggccgcacaccacccagacgtgctaacggacgatgtttacgaacgcctatttgaaatagtattttatcaaaggccactcaaagcaccccagatcggaatgtgcacactaatagccggggaccgaagactccccaaagcacacccactattccaacgacggcgcctactagaagaactgaacgccctaatgatagtccgacccggagaagtagcacaacggctcacacgggaagaacgagataccctgtttctcaaactgaaagacagaaacaaagtctcatttgaatcactgcgaaagacactcaaactcgacccagacgcaagattcaacaaagaatcagaaaaccgaaccgaattgaaaggcgacgaggtggcagcagcaatgggcagtaaaactcgattcggaaatagatgggtgcacctaagtatcgaggagcaatgggctgtaatagaaagattaggagacgtagagagcgacgcagaagacgcggcattcagagcatggctcgccgaacgttacgaactgacaccggagcagacgcgggcagtaacaaacgcaccactgccacaaggatacggcagattcggagagaccgcaacaagaaagctcatcgatgcgttaagagacggagagaaagacgggcgagtcttggtgtactcggaggccgtgacggcggctggactaggccatcactccgaccgcagaacaggggaagtgtttgaggacgaagaggggaggccgcagctaccttactacggggtggcactagaaagacacataatgcccggaacaggagacccctcagacagcgacgaaatgcgtgtgggcagattaacaaaccccaccgtgcacatcgggctgaaccagcttaggcgcatagtaaaccgactgatccgtgcatacgggccaccggcggaaatagcgatagagctagccagagaactaaaactgacggacgaggacaagaaacgcataaacaaagagaacaattcaaacagactggacgcagagcgacgcagcgaaaagctgctggcgatcggaaaaccagacaccggggctaacagagctctactaaaactttgggaggaattaaaccccgcaaatgtactcgataggagatgcatctacagcggagtccaaatctccatagacatgctattctcggctgcagtagaggtcgaccacatattaccgttcacagcgacactagatgacagcaacggaaacaaaatagtatgcacaagagaagcgaaccgggagaaacgtaagaggagtccttacgaagcatggggacacagcgcaaggtgggaggaaattgcggcacgggcagcgcaactacccagaaacaaaaggtggagattcgaaccggatgcgatggaaaagttcaaagacgacggcggcttccaggcaagacacctaatcgatacccaatacctagcacggctgtcccgggaatacctggcaacactatacccagacaagggagaaggctccggtcacatatgggtaagcccgggaagactcaccgaaatggtcaggcgaaaactgggccttaacgacctactaccagaccacaacttcggcgggggagcagatcaagccaaaaatcgactggaccaccgacaccacgcaatagatgcagtagtggtagcaatcgtcgacagaggcatgctaaacagaatagcacgcgcgtcgggccaggaaggggccgaaggcagagaaaggataataatcccggaaccttgggaagggttccgcgacgacctaagaacagcagtaaacgcgataacagtatcccaccgaacagaccacggaacagcaagcaaagcagggctaccgaagggcaaggacgccaccgccggacgactacacaatgacaccgcctacggatttacaggagaatcagacgcaaagggcaacagcatcgtagtacgacgggtaccgctgtcatccttcaagaaactcgctgacattgacagagtacgagacccggaactcaaagcggccctctaccaacacctagacgggctcgagggaaaagcattcgaaaaagccatcggggagttcggcagtagggaatggcacccctatggcggcgtaaggcgagtaagagtaacagagccactaagcgtcatacccataagagaccgaaacgggcacatatacaaaggctacaaaggagacagcaactacagatacgatgtatgggagctaccaggaggcaaatgggtcaatgaagtggtgagcatgttcgacgcgcaccaacccggctggcagagcgcaatccgagcagcaaacccaaccgcccgaaaagtgcttagcctccacagggacgacgtactcgccatagaacgaaacggcgctgaacgcgagctagtgcgagtagtgaaattctccgaaaaacagttcgccgtcgcaccacccaacgaaggaggggccctgaaggctcgggacgcagacaaaggggacccattcaaatactcataccccagtccgaacacactgaaggccctaagagcccgacaagtgcgaatcgacgaattgggacgcgtcctcgaccccggcttcccagcaaggaccaagcaacgaaaaacaagaaaaccaaactga

SEQ ID NO: 7258 - RNA, 3132 nt, synthetic construct
  misc_feature 1..3132: note = Cas9 variant
  source 1..3132: mol_type = other RNA
atgcagagagacaacccactggtatacagactagcactggacttaggcagcacgagtctcggctgggccgtttttagactggacgcggagggaagcccattagcaatcataaaagcaggagcaaggatattcagcgacgggcgcaaccccaaagacgggagcagcttagcagtcacgcgacgggccgcacgcgcgatgagacgaagacgcgatcgcctactcaaaaggaaggcacgaatgctaggagctttagaacgacacggctttttcccgcaagacgaatcagcgcgaaaagtactcgaaacattaaacccattcctcctaagggcgcaagggctagaagtagcgcttaaaccagaagagttcggacgggcactattccacctcaaccagcgacggggcttccaatcaaatagaaaaactgacagaaaagatagcgacagcggagccctaaaacaagcaataggcacattgcgggcacagatgcacgaatcgggatgtagaaccgtcggggaatggttctggaaggtcagaatggagcataagcccgaaggggtcaaaggccaaggagtccgagcgcgctaccgcgaaaccccattcacaacagatgaaggaaagaaacgaatagacaaacgatacgacctctacgtggatcgagccatggtcgcgcaagagttcgatgccctatgggcagcccaggcggccttcaacccagcactatttaacgaagcggcacgagccgaactccgcgacatcctcctacaccaacgaaaactccgcccagtacaacccggaaggtgcaccctagtcccagaagaaccccgagcattacttgccctatcatcaacgcagcgctttcgaatctaccaagaggtaaaccatctgcgcgtcctccacgacgaactccgtgaggaaactctgacactagcacaaagagaccaaatcgtcgccctgctggaaaaacaagcgaaagtaacattcactgccatgcgaaaagcactcgggttcagcgcactattcaatctcgaggatgcaaaaagagatgggctcaaaggcaacgcgacagccgcagcactaagcaagaaagacctcttcgggccactgtgggctggattcggaaccgcactacaggacgagatagtaacgcaactaatgacggaagagtcggagccccgcctaatagcgtggctgcaagaacacacgggcgtcgacgaagcaagggcccaagcaattgcaaataccgggcttccagagggatacggaagcctaggtagaaccgcactagccaggatcgtcccagaactccaacgcgacgtgatcacctacgacaaagcagtccaagccgcagggttcgcacaccactccgacctgggcttcagcttcgagcacggtgcagacgaggtcgaacgcataggcgaacgaacaatcgcatccacaggtgagatcaaacccgtgttcgcattcaaacaactaccatactacgggcgagcgctacagcggcacgttgcattcgcaaaagacaacccacgcaacgacgaggaacgatatggaaaaatagcaaacccgacagtccacataggactgaaccaagtaagagtagttgtaaacgcacttatgcgacggtacggacgcccagccgaggtagtgatcgaactcgcaagggatctcaaacaatcaagagaacaaaagctagaagcccagcaaagacaggcagacaaccaaaagcgcaacgcgcgaatacggaggagtatagcggaagtgctgggaatatcagaagaaagagtccggacactcgacatccaaaaatggatactatgggaggagttaagccacgacgcagcggacagacgatgcccgtacagtggtgtccaaatcagcgcaagtatgctcctcggcgaaagagtagaaatagaacacatcctccccttcagcatgacactagacgacagcctcaacaaccgtaccgtcgccctgagggaagcaaacagaataaaacggaaccgcgcaccctgggaagcgcgagccgacttcgaagcccaagggtggtcgtacgacggcatcctccagcgcgcggaaaggatgccgctaagaaaaagatacagattcgcaccggacggttacgaaagatggctgggcgaagacaaagacttcctcgccagagcgctaaacgacacgcgatacttaagccgcgtcgcagcagaatacctcaggctcgtctgcccgggatcagccacaagggtaatccccggccaaatgacagcactcctgcgcggaaaattcggactcaacgacgtactcggactcgatggagagaaaaaccgaaacgaccacaggcaccacgcggtcgacgcctgcgtaatcggagtaactgaccaaagaatgatgcaacggttcgcgcaggcgaacgcacaagcacgagaagacgggcttacacgcctagtagaggacatgcccttaccctggcctacgtacagagaccacgtcgaacgcgcggtgcaccacatctgggtaagccacaaaccagaccacggcttcgaaggggccatgatggaagaaacaagctacggcatcctcagagatggctcaatcaaacaaagacgaaaagccgatggaagcgcaggacgggaaatcagcaatctaatacgcatagccgaacccggccaaccacagcgacacggggtggacgcagagggccgaccgttaccatataaaggatatgtaggcggctcaaactactgcatcgaaattacagtaaacgacaaagggaaatgggaagggcaggtaatatcaacgtttgatgcatatcgcatcgtcagagaaggaggactccgacaactccgccacccgacacaagggcagaacggacgcgctctcgccatgcgcctagtaataggagactccgtacgtctcgaagcgggggaaggatccctgcaaacactgcgtgtcgcgaaaatgtccgcggcaggccaggtgttcatgtcagaagtcaaccaagccaacgtcgacgcgcgcaaccgcaatggggacctcccctacgtcagtaaaatggcgggctcattccaaaaggcgcgcgcccgccaggtaacaatatcacccataggtgaactacgggatcccggcttcaaagggtga

SEQ ID NO: 7259 - RNA, 3135 nt, synthetic construct; identical to SEQ ID NO: 1459
  misc_feature 1..3135: note = Cas9 variant
  source 1..3135: mol_type = other RNA

SEQ ID NO: 7260 - RNA, 3135 nt, synthetic construct
  misc_feature 1..3135: note = Cas9 variant
  source 1..3135: mol_type = other RNA
atggccgagaagaagttcaagtaccgcctgggcctcgacctggggaccaactcaatcggctggtgcatgctgcggctcaacaaggacaatgagcccgccgcggtgatcaagtccggggtccgcatcttccacgacggccggaacgagaagaccaaggagccgctggccgtggtgcgccggaacgcccgcagcatccggcgcaacctggaccggaagatctcccgccggaaccacctcctgaacacgctggtcaagtacttcctcctgcccagcaacgagatcgaacgcaaggccctggccgtgctcaacccctacgagctgcggtcccgcgcggtcaacgagcggttggagctgttcgagcttgggcgactgttaatgcacctgagcaagcggcgcggcttcaagtccaaccggaaggtcgacaaggaggacagctccggcaagatcaagcccgccatcgaacgcctgaagaataagatgcaggagaccaacaagaagacagccggggagtacctctacagcctgatgcagaacggcaagccggtgcgggcccgcctcgggcgcatcgacggctccaacgggtacgagatctacctcgaccgggcgctgatcgaggaggagtacaacctgatcatgaacgagcagaagaagcaccacaaggagctcaccgacgacatcatcaacgagatcttcaacatcatcttctaccagcgccccctgaagaagcagatcatcggcaagtgcagcctgacgggtgaggacaccaagctcaagaaggcccacgtgctggcccaggacttcatcctgctgcagaaggtccaggacctgcgggtgttcgacgacaaccagctggagttccgccccctctccaacgacgagaaggacatcatcaagcgggagctgcgcaagaagaaggaggtaagctacgagaacatccggaaattgctcaagaagtactacgagaacgtcaagtatgggatgttctcccacgagaccctatacaagaagctgcagggcaacaaaacaaacgccctaatgagcgacaaggagatcatcggggactcctggtacagcctgtcccccgaggtgcagtacgacatcatcgaggagttgtacagcgacaaggacaacgacgagctcagcaaactttactccgagaagttcaacctgaacgagagccagatcaacggcctcttgaacaaggccatctacagacttgactccggctacatccgctatgggaagacggcggtgaccaacctgaactcgatcatggacaaggacaacctcaacctgcacgacgcccgcgaggaggccggctacgagaaggagaacaagcaggacgcctccgagtacctggagtactacgggaaggtcctcccggacagcgtggtggacccccagattgagaaccccaagaacgacgaggagcggtacggcaagatcgcgaaccccaccgtccacgcggccctgaatcagctgcgcaagctcgtgaacgagctgatcaagctgtacgggaagccggagcagatcgtgatcgagctcgcccgggacctgaagaactcccgcaaggccaaggacgtcatcaacaagaagattgccgagaaccggaagctgaacgaggaggtggacaagaccctccaggagtacagcgagaagtacaacacgcacatcgtgaagaacaagctgaaccgcgacaaggtcaagctgtggcgggagctcggcaaggaccccctggagcgcaagtgcatctacaccggggagcagatcaacatcgcgaagctgttctccgacgaggtgcagatcgagcacatcgtcccctacagcaagaccctcgacgactccttcaacaacaagaccctgagcatgaagcaggccaactactacaaggggaacaagacgccctacgaggccttcaaggactccaaggacggctacaactacgacgacatcatcgcccgggccaagctgctcaacaacgacaacaagttcaagcgcttcacaaaggacgcgatggacatctacaaccgcgacgggaaggacttcatcgcccggcagctgagcgacacccagtacctgtccacccgcgcgctcatctacctgcagagcctgtacgaaaaggcccaccacagtagtatctggacgatcccgggccagctcacagcgctgatccggaactacctggggctcaacaccctgatctccaacgacaagaacaagaaccgcaacgaccaccggcaccatgccgtggacgccttcgtggtcgccgtgaccagccgctccctgctccagaagatctcctacgccgcgagcctgcaggaggacctggacaaccggaacgtgtccagctaccgcaacaagctcctggagaagatgcccgagcccttccctaactaccggaaatccctggagctcgccatcgacaacatcaagacgagccacaaggccgaccgctccatcagcggcaagctgcacgaggacaccgcctacggcatagtcgagaacgacgacaagtacaacgtggtgacccggtggaccgtcgacaagttcaaggagcagaagcacttcgagacgatcagagacaacgagctgaaggagatcgcctgctccgacaaggagctgttcgcgaagatcgtggaaactcggaagatcaagagcatacgcaagctcgccaaggagaacccggtgatcaagatcaaggacaagtccgggcgggactacaaggccttcgccggcgggaacaacatctgcgtcgagatctacgaagtggacggcgtgcgcaagagcgaggtcatccagctgttcgatgccgcgcagaaggggttcatgcccgagtggatgaagaagtaccccaacggcaagctcctgatgcggctgtttaagggcgacgtgatcggattcatcgagaaccgcaaatacaactactacaccatcaagggcatatccatagccgaccagaacctcaagttgctggccatcaacaaggccgaggggatcttcaagaagggtctcaacatcctgttcgacagcaacaacaagaactccctgaacgcaaagcagttcaacatcagcgtgaccggcatcgtcacgaagaagaagaccgccgacgtgaacttctggaagaaccggaagtga

SEQ ID NO: 7261 - RNA, 3135 nt, synthetic construct
  misc_feature 1..3135: note = Cas9 variant
  source 1..3135: mol_type = other RNA
atgctccacaaaatgcgatacagactagcccttgacctcggcagcacgtccctcggatgggccatggtgcgactcaatgccaaccaacagccatgcgccgtaattaaagcgggcgtccgcatcttctctaacggacgcaaccccaaagacggcagctcactcgccgtaacacgccgagaagcaagatcgatgaggcgacgacgcgaccgactactcaaaaggaaggcaagaatgatgcgcacgctaatagaatacggattcttccccgccaacgaaacacaacgaaaagctctagaaaacctaaacccgtacgcactccgcgccaagggcctagacgaagccctaacaccgtcggagttcgcacgggccctcttccacatcaaccaaaggcgaggttttaaatccaaccgaaaaacagacaagaaagactccgattctggggccctcaaaaccgccataaaacaacttcactcagtgctcgacccccaaggcaacgacggaaagcccagaactgttggcgaactactctacaagcgcttcacagacctatctaaattaccgaaagaccggacggtaagagcccgataccgccaggacaagatagtaaaagacgacggcaaaacaaaaatcgacaaatactatgacctatacatcgacagagccatgatcgaacaggagttcgacgccctctggaagaaacaaagcgaactaaaccctatacttttcaccgaaaacgcccgcgcagacctcaaagatgtactcctgtaccagcgcagcctaaaaccggtcaaaccaggacgctgcacattcatgagcgaagaagaacgcgcgcccctagccttacccagcacccaacgatttcgcatgtaccaggaagtaaacaacctacgtatcctccgagaaggcctaaaagaagaatccttaacactgcaacaaagggacgacttaataaacgcactagagaaaaacaacaggagaacattcacgcaaataaagaaacttctgggggtcgggggcagcgtccaattcaacttcgaagaccctaaacgcgaggaactcaaaggaaacaccacgtccgcgatcttagggaaaagcgaacacttcggggaagcctggttcgccttcaatgaagcaaaacaagacgccatcgtacttcaactgattaaagaagaaaacgaagccaagctagtacgctggctccaggacgagaccggaatcgacgaaaaacgagccgaagtcatagccaacgcaggcctccctgagggctatgggagcctttgcatagaagccctcgcacgaatcctcccagagctccgtagagacgtagtcacctacgacaaagccgtccaagccgccggcttcgaacaccactccaaactcaaccgcaacgaggagatacccgacattaccttcaaaatagagagcatagaccgaaactccggcgaaattaaacaattccacctacacaaagaactaccatactacggagaatacctccaacggcacgtgggattcggatcaggcaaacccgaggactcgatcgagaagcgatacggtaaaatcgcaaaccccaccgtccacataggcctaaaccaagtaagagtagtcgtaaatgccctaataaagagatacggccacccaagcgaaataatagtagaggtagcccgcgacctgaaacaaagcaaagaccgcagggacgaagaaaacaaaagacaagcggagaaccaaaaacgtaatgaacgcctgaggaaagacatagccgacatcctcggaatatcggaggaacgcgtgcgccgagacgacatagagaaaatgatcctttgggaggaattatcattcgaccccgccgacagacgatgcccgtattcgggagtacaagtgagcacagttatgcttcttagcgacgaagtcgaagtagagcacatactcccattcagccaaacacttgacgactccctcaacaacaagacggtggcattacgacaagcaaaccgaatcaaaggcaaccgcacaccctgggaggctttcggaaccagtaacataagcggatttgactacagtggcatcctcacacgcgcagaactgatgccaaaagcaaaacgctatcgcttcgccgaagacggctaccaacgttggctcaaagacgacgctgggttcctcgcacgagctctcaacgacacaagacacctcagtaaaatagcaagggaatacatgagcttaatctgcccaaacacgcgcgtaatacccggccagatgaccgcaatgctacgacgaaacttcggcctcaacgacgtcctcggactcaacggagagaagaaccgcaacgaccaccgtcaccacgccgtagacgcctgcgtgatcgccgtaacagaccagggcctgttacaacgtttcgccgcggccagcgcctccgcaagagaaagacaactaaaccgcctggtagaaaacatgccactaccctgggaatcatacagagagcacgtccggcgcgctatagacggaatctgggtcagccacagacccgaccactcacacgaaggcgctatgcacaacgacactgcctacgggctccgagggaacggccgagtgtccttccacaaaatggtcgagggcaaacgcgaatacatcgaagacaacctcaaagtgatcgaaataacagataccaaagcgatagaccgccacggcctattgccgacgggaaaaccaagaccgtacaaaggctacaaaggcgactccaactactgcatcgagatagtgcgtaacgaaaaaggaaggtgggaaggcgaaatcatatcaaccttcgacgcataccaactggtccgcaagtacggaatagtacagctacggtacccagtcctgtcagtctcgggtaagcccctagtcatgcgattaatccgaaatgacttcgtccgccttgaacacgaagggatcacccgcacgcttcgagtatgcaaaatgcgagaagacggacaagtggcactcgcggacgtaaccgaggccaacgttgacgcccgaacacggacaaaagaaatctgctatgtgttcaaaaccggaggctcactgcaaaaagcaaaggcacggcgaattacaatcagccccattggggaactccgggatccaggattcaaggagtga

SEQ ID NO: 7262 - RNA, 3138 nt, synthetic construct
  misc_feature 1..3138: note = Cas9 variant
  source 1..3138: mol_type = other RNA
atgcaaaaagaaaaacctctcgcctaccggctcgccctggacctaggctccacatcgctcgggtgggcggtactgcgcctaagcgcccccggggaaccaagcgcagtaatcagagcaggatcacgaatattcagcgacggccgcaaccctaaagacggaagctccctagcggtgacccgccgagccgcccgtgcaatgagacgaaggcgagaccggcttctaaagcgcaaagcccggatgctggcggccttagaacgccacggctttttccctcaagacgaagcagccaggaaggcactcgaaaaactgaatccatacggcttgcgggccagaggcctagaaagcgcactaaaaccagaagagttcgggcgcgcgctattccacctgaatcagagaaggggctttcagagcaacagaaaaacagaccgaaaagacagcgacagcggagcactaaaacaagcaatcggcaccctccgagcacaaatgcacgaaagcggctgccgcacagttggtgaatggttctggaaggtacgtatggaacgaaaaccggagggagtaaaaggccaaggagtacgagcaagataccgcgaaacccctttcacaacagacgaaggcaagaaacgaatagataaacgctacgatttgtacgtcgaccgggcaatggtcgcgcaggagttcgacgccctatgggcagcacaagccacgttcgctccagccctattcaatgaagcagcacgggcggaactgcgagacatcctactccaccaaagaaaactgcgcccggtccagcccggacgatgcactctggtaccagaagaaccccgagccctactagcactaccgagcacacaaagattccgtatataccaagaggtaaaccacctccgcgtgttacacgacgaactaagggaggaagccctgacactggcgcagagagatcagatagtggcactactagaacgtcaagccaaagtaacgttcaccgccatgcggaaagcgctcgggttcagcgcactattcaacctagaagacgcgaagcgcgacggactcaaagggaacgccacaacagcggccctgggtaagaaagacctattcggccccctctgggcgggattcgacacggcactgcaggacgagatcgtgacgcagctcatgaccgaggaatcagagccgagactgatagcatggctacaggaacacacgggagtagacgaagcccgcgctcaagccatagcaaacgccggattgccagaagggtacgggtcgctcggccgaaccgcgctagcgcgcatagtaccggaactacaacgagacgtgataacatacgataaagcggtacaggcagccggattcgcacaccactccgacctagggttttctttcgaacacgacgccgacgaggttgagagaatcggagaacgcacaatcgcctcaaccggagagataaaacccgtatttgcattcaagcagcttccttactacggacgagcgctacaaagacacgtcgcattcgccaaagagaacccccgtaacgacgaagaacgatacgggaaaatagcaaacccaacagtacacatcggactaaaccaggtacgagtagtggtaaacgccctaatgtgcagatacgggcgaccgaccgaagtcgtaattgaactagcaagagacctcaaacaaagccgtgaacaaaaactagaggcccaacaaagacaagcggacaatcaaaaacgcaacgcaagaatcaggcgctcaatagccgaagtccttggaataagcgaagaacgcgtcagaaccctagacatacaaaaatggatcctgtgggaagaactatcacacgatgcagcggaccgaagatgtccctactcaggcgtacagataagcgcgagcatgctcctaggcgaacgagtggaaatagagcacattctgccattctccatgactttagatgacagcctaaacaaccgaacggtagcattaagagaagcaaacagaatcaaacgaaaccggacaccatgggacgcaagaacagacttcgaagcacacggatggtcatacgacgggatcttacaaagggccgaaagaatgccgcaacgaaaaaggcacagatttgcccccgacggatacgaaagatggcttggcgaagacaaagacttcctggcgcgagcactaaatgacacacggtacctcagcagggtggccgcggagtatctgcggctcgtctgcccaggcagcgcgacgcgagtgatccccggacagatgacagctctactaagaggcaaattcggactgaacgacgtactcggcctagacggcgagaaaaacaggaacgaccatcgtcaccacgcggtggacgcatgcgtcataggagtgaccgaccaaagaatgatgcagcgcttcgcacaagccaacgcgcaagccagagaagatgggcttacgcgactcgtcgaagacatgccgctaccttggccaacctacagagcacatgtcgaacgggcagtgcgacacatatgggtcagccacaaaccggaccacggattcgaaggagccatgatggaggagacaagttacggaatcctgagagacggtacaataaaacaacgcagaaaagccgacggctcggccggccgggaaataagcaggctaatccgcataaccgagccctcccaaccgcaaaggcacggagtagacgccgagggacggccactaccctacaaagggtacgtaggcggatcaaactactgcttggaaatcacagtaaacgacaagggcaaatgggaaggccaggtcataagcacgttcgacgcatacagaatcgtcagagaagggggactacgccagctacggcacagcacacagggccagaacgggcaagcgctcgcaatgcgactcgtaataggcgactcggtcagacttgaggtagacgaacaagaaagggtaatgcgaatcgtcaaaataaacggcaacaacggacaagtattcatggcaccggtccatgaggccaacgtggacgcgcggaacagtgacaaaaacgaagcattcgcttacacctcaaagatagcagggagcttccagaaaacaaaagcacgacaagtaacgatatcgccgataggcgagctccgcgacccaggattcaaaggatga

SEQ ID NO: 7263 - RNA, 3138 nt, synthetic construct
  misc_feature 1..3138: note = Cas9 variant
  source 1..3138: mol_type = other RNA
atgaaaccccgcaacctaaactacatcctaggactcgacctcggtatagcatcagtcgggtggtccgtggtcgaaatcgacgaaaatgagtacccgataagactaatcgacgtaggagtccgtaccttcgaacgagccgaagtgccaaaaacgggcgaatcactagccctcgcaaggaggctcgccagatcgaccaggcgtcttatacggcgccgggccttccggctcctcaaggccaaacgactcctaaagcaccaccaaatcgtaaatgccgaagaactcacccaactacctaatcaatgctgggaactccgagtcaaaggactggacagcttgctatctaacacagagtgggccgcagtcctactccacctcctgaaacaccgtggctacctcagccagaggaaaaacgaagcccaaaatgcggacaaagaactcggcaaactacgagaagggatggacaataactccaaactcctactcgaaaacaactacagaacaccagccgacatcgccgttaagaaattcgctgtagaggaaggccacatgcgcaaccaacgaggagcatatacccacacattcaacagactcgacatactagcagagatgcagcttcttttcaagacccaacgcgaactaggtagtacctacgcgaacggcgaactcgagcaagcattctgcgaactcctcctttggcaaaagcaagccctaaacaggtcacagatgctgtccctagttggcaaatgcaccttcgaaaaagaggaaaagagggcggctaaagcctcctactccgccgaacgcttcgtcgcaatccagaaactgcaaaacctccgaatcctagagaatggcgaagaacgaggactattcgatagcgagttctcactgctactagaaaacgcttacaacctaaaaagcggcctcacatacaaacaagtgcgcaaaatcctgagcctcagcgaaaacgccatattcaaaggactcccgtacctatccgacgacctagaaaagcccgagaagacccaattcctagccttcaaattctaccaccagctagccgacatactgaaaaacaacggcttcagcgacgagtggcaaaaactcagccaagagcctaccctcctcgacaaacttggcacagaactctcactatgcaaggaagagaatgagttcatcgcacaattcaacggcgaactcccggaagccatgctctctacactcttcaaccatacgaacttcgacaaatttatccatataagcctcaaagcactaaataacatactccccttaatggaacagggcaatgactatacaaaagcatggcgaaaagtatacccagagcccaccaagaaggacgagaaaaccctacccccaatcccagccgatgaaatcagaaacccagtcgtgctacgctccctctcccaagcccggaaggtaatcaacgccgtcatccgcctctacggaagtccagcccgaatccacatcgaaacggcccgagaactaggaaaatcctacgacgaccgccaaaagataaagaaacaacaggacaaaaacagcgacgagcgagaccaagccgtcaagaaattcctcgaggagtgccccaacttcgccaacaaagtaaaaggtaaagacatcctaaaaatccgactctatatcaaccaagacggcaagtgcctatattcaggcaaaccgttagacccccaccgcctactagaaataggctacgtcgagatcgaccacgccctcccgttcagccgcacatgggacgacagccagaacaataaagtcctagtactagcgaacgaaaaccagaacaaaggcaaccagaccccgttcgaatggctgggtaaagatgagcaccaatgggccctcttcgtcgcccgagtaaacggatgccggttcccttacgcaaagaaacaacgcattctcacaaagaaattagacgaacaaggcttcctgaaacgaaatctaaacgacaccagatacgtaagcgcctacctaatgaaacacatcaaagaaaacctgcacttagtcggaaaaggctccgataaagtcttcgcctccaacggtcaagtcacaaactttctccgcagatgttggggactcgaaaagaaacgagaggagggcgaccgacaccatgccctcgacgccatagtggtagcatgttcgacagccagtatgcgacagaaaatcacactgtttaaaaagtatcaacgctggaacctcaagaccggaaaacatatagaccaagaaacaggcgaaataatcccgctccatttcccagcgccgtgggacttcttccgtcaggaagtcatgattcgcatcttctcagagatgccccaggaagacttaataatgcaactcccagacaggccacaggccaaccacgagttcgtacaaccactcttcgtctcaagagctccatcccggaagatgagcggccaaggccacgaagccaaattgcgatcggcgcgaatgctcgaagccacaggtaaatcaataaagaaagagttcctaaccgacctgacaatcaaaaacctcgaacacatggtaaacaaggaacgcgagccggaattataccaggccctagtcgaacacttcaagaaatacggagacaaacccaaggagaaattcttcaagaaaggcggcgtagaggtaaaaagcatccgcatatccaaaacccagaacaaaagcgtaaacctaggaaacaaaaccatcgcagataacggggacatcgtaagaacggacctcttcctcaaaaacaagaagtactacttcgtgaacatctacgcatggcaagtctcaaaaggaatactgccgaaagaaaccacgaccggcaacatcttagacaactcgtacgagttccaatttagcctattcaaaaacgaccttctggaaataccacaccccaagaacgaaaacgactcaatactcgcctactttataaggcccgacgacgaacgacgctggatcctaaagttccatgacaacgcgaaaattccagacatctacgggaagaaagacgaaacttccatcaggctcagcatccaaggccaaaaattcattaagaaataccaagtcgacgagctgggcaaaaatatccgtccctgccgacccacaaaacgacagggcgtgagatga

SEQ ID NO: 7264 - RNA, 3141 nt, synthetic construct
  misc_feature 1..3141: note = Cas9 variant
  source 1..3141: mol_type = other RNA
atgaaaatatactcctttgatataggagtagcctcaatcgggtgggcattcatcgaaaacgaagtactccaagactgcggcattagaattttcacaaaggcagaaaacccgaaaaacggggcctccctggcgctaccccgccgagaagccaggggagtacgcaaaagactagcgagacgacgtggccgcctaaacactatcaagcaacttctctgcaaagagttcggactacagctcgaagactacctttccaacgacggtgaactaccaaaagcctataccgcctcaaaagccaacccgctaaaaagcccatacgaactaagaaccctggcccttagccaaaaattagacagcaaagacctggtcagagtaattctccacatcgccaaacaccgaggatacggcaacaagcacgccaaagactccaaggacaccgaaagtggaaaagtaaagaaagctatagagttcaacaggaaaacgctcgccgaaaaagggtaccgctcagtcggcgaatatctatacagggagttcttccaacaaagcagaataagccaaaacaacggtgctaccgagttcgtgaacgtacgaaacaaaacgggcaactacgaacactgcgtagcccaagacatgctgaaagacgaactcgaactcatattccgaaaacaaaaagaactgggcctccacctaagcgatggattcgaaaagcaactcctagacaaaatcttcgaacaacgacccctaaagagcttcgccgacaaggtcggaaaatgccaattcatcgccggagcaaagagagcccccaaagactcaatcagcgcgattgagttcgtagcactgagccgaatcatcaacaccctcgctaatctctcgaagaaatccggcgaaatgtacgataaagcaatggtgctaaccatcctcgacagcgtactcgaaaaaggagaaatgtcctactacgctctacgagaagccataaacctcgacgagaaaatccgattcgctgatagcagactcgactacagcaaagagatcaaagaaaccgaaaaagtaaaattcgtcgagtgcaaaaacttaaaatcgttcaagaaagtcctcggaaactgctacaaaacccttgagcgaaaacacatcgacagcatcgccgaacgaatagctgtcataaaagacgtagaaaaactccacaaggagctcgaatcgtactgcgcaactgagcagctgagcctcacatcagaacaaatacaagccctgagccacctaaacttctcaagccatatctcacttagcctcaaggccctagagcagatcctgcccttcatgagaggcgaacgcgaggcaagatcctccgacgccgactactgcataggcatagacgaaagcggagaaagccaatgcctcaggtacgacgaaagcgtagagaaagccggcctaaaggccctctcaaaggacaccctaaagggccaaatcctaccgcccctaaacgagttcgaaccctacctcgcaaaccccgtcgtggcccgagcgcttgccgaatacaggaaagtgttaaacgccctcctaaaacaatacgggtcaccccataaaatacacatagagtatgcccgggaagccaaactaaacacaaccgaacggcaaaagtacgaaaaggagcagaaagacaactacgccgccaaccaggccgcacacaagaaatgccaagagctcggcctggaacccagctcaacaaacctgctgaaacttaagctctggcaagaacagggcgggctctgcctgtactcaggcgcgaagatcacaataagctacctacaggaccccacagcactacaagtcgaccacatatacccctactcacgatcgttcgatgacagctacatgaacaaatgcctcgtcctcacaaaagccaaccaagagaagggcaaccgcacacccttcgaagccttcggcacagactcggcaaagtggggtgtgatcactacactcgcacagaaactaccccacaagaaacgccgccgcatactcaacaccgcattcaatgacaaagaagccggcttcaaactccgtaacctcaacgacaccagctacatcgcacgccttgtagccgactacacggaaacctacctcgagttcctcagcctggtcgaatctgaaaacacaacacttggcaaaggacagaaaggcagcaaaaagcatatagccatcgtaaacggcgccctaaccagcacaatgcgctactacctcggcttcgcatcaaaagacagagataaccacctccaccacgcactagatgctgtgattatcggcttcatgaacgactccgtcataaaggcgttcagcgacttcaagaagacccaagaaacgagcaaagcggcttactacgcccacaccctatccaaacaagaatacaagaaacaaagggccttcatacaattgccctccggggagaatttcagagccaacgtcctggaaaaagccgaaagcgttttcgtatccaaacctcccaggaaacgcgtacgcggcgccttacacgaggaatcattttattcacagaacgacaccaaactgctaaaatcctacgggggtgcggaaggaatcgaaaaagcactccaactgggcaaaatccgccaaataggaacaaaaattgtaagcaacggagccatggtaagagtcgacatcttcaagcaccgaaaatccgggaagttctacggcgtacccgtctacaccatggacttcgccctaggcattctgccgaacaaagccgtcgtccaaggcaaagataaaaacgacgtgatcaaagactggctcgaaatggactcctcgtacgagttcatcttctccctctacaaagacgacctcctcttagtgcaaaagaaagagatggccgagccagagctatgctacttcgtcagcttcgacacgtcgggcgcgagcattaaagtagcaaaacacgacaacaacttctccacgctaacagaaaaccaaaaattattattctccaacgccacgaaagaagaggtcgttgggaaatccatcggaatacaaaatctaaaggtcttcgagaagtggcaggtttcggtcctcggggaggtcaaacgcacacagagctacccccgcgaaaacatctccctcgcctcgaaggcaaagaaatga

SEQ ID NO: 7265 - RNA, 3144 nt, synthetic construct
  misc_feature 1..3144: note = Cas9 variant
  source 1..3144: mol_type = other RNA
atgaaactactacgctacattctaggactagatctcggcatcgcatccgtcgggtgggcaatcgtcgaaatagacgagaacgacttcccaatacgactcatagacataggtgtacgaaccttcgacaaagcagaagtctcaaaaaccggcgaaagtcttgctctagcccgccgactagcccgcagcacccgccgcctcatccgacggcgcgcattcagactactaaaaggaaagcgactactgaaacaacataatgttataaacaaagaggccctaacaaccctacccacggactgttgggctctacgcgtcaaaggtctagatgaacggctctcacctaccgaatggagcgccgtcctcctgcatctgctcaaacaccgtggctacctaagtcagcgcaaaaacgaagccaaaagtgcagacaaagaaatgggtgccctattaagcggcgtggcatcaaaccaccaattgctagtcgaaaaccaattccggacacccgcggagatagcagtgaagaagttcgcactagaagagggacacatccgaaatcaactaggagcctacacacacacattcaacagactagacttactcgccgaaatgaagctactatttcaaacccaacgcgagctaggaaacccccacacaagcgggcaactggaacaggagttctgcgaacttctaatgtggcaaaagccagccctctccggcgacgccatcctcaaaatgctaggaaaatgcacattcgaaacaaacgagtataaagcggcaaaacacagttacaccgcagagaggttcgtgtggctaacaaaactgaataacctccgcatcctcgaacacggatcagaaagagtactaaataccgacgaacgctcactcctactaaaccaaccctacgaaaaagcgaaactaacatacacacaagtacgcaagctcctgggcctttccgaggaagcgagattcaatggggtacgttacggaaaagaaaaggccgaagacgctaccctcatagaactcaaggcataccacgctatccgcaaggcagtcgagaaggcagataaatccgcatgggaaaccctgaaaaaccaaacggcactgctggacgaaatcggaacgacgttcagcatatacaaaaccgacgacgacatcacagagcaactgaacggaaaacttagcgacacagtactgaacgcactcctcgaaaacttaaacttcgacaaattcatacagctaagcctcaagagcctctacaacatagtacccctgatggaacaaggcctgcgatacgacgaagcatgccaacaaatctatggagaccacttcgggaagaaaagcggcgaaataaaccgactactcccacccatcccggcagacgaaatacgcaaccccgttgtcctccgcagcctaacacaggccagaaaagtcatcaacgcagtcatccgcctctacggatcgccagcacgaatccacatagaaaccgcacgcgaactcggaaaaagctacaaggaccgcaaagaaatcgaaaaacgacaagaacagaacagagcggaacgcgaaaaagcaacagcacaatttaagaccctgttcccaacattcataggcgaaccaaaagggaaagacatactcatgatgagactctacgagcaacaaaacggacaatgcctatacagcgggaaacccctcaacctcaaccgactactcgagaaaggatacgttgaaatagaccacagcctcccctttagccgtacctgggacgactcccagaacaacaaagtcctggtactagccggagaaaatcagaacaaaggaaaccaaacgccattcgagtggctcggaaaagacgaacaccaatgggccctcttcgtagcacgcgtcaatggctgcagatttccctacgccaagaaacaacgtatcctaacccaaaaactcgacgagcaagggttcatcgaacgcaacctaaatgacacacgctacatcgcccgcttcctcgtcaacttcgtcagggaaaacctacacttaaccggaaaaggcaaaaacagagtcttcgcctcaaacggacaaataacggcgttcctcagaggccggtggggcctttccaaagtccgcgaggagtcagaccgacaccacgccctcgacgcagtagtcgtagcatgcagcacagtggccatgcaacaaaagatcacacgcttcgtcaaataccaggaagggaacctccaaaccgccgaacgaatagaccgggagaccggggagataatacccctccacttccccgacccgtggcacttcttccgccaagaagtcatgatccgaatcttcagcgaaaaccctcaggaagacttgataatacagctaccagacagaccagaagctaaccacgagttcgtgcagccgctgttcgtcagccgcatgccaacccgcaaaatgagcggccaaggccacatggaaacaataaagtccgcgaagagactcgacgaaggaatctcagtcagcaaagtcccccttacccaactcaagctgaaggacctcgacaacatggtcaacagagaacgagaaaaagcactctacgaagcactaaaagcgcgcctgaacgccttcaacgatgaccccacgaaggcgtttgcagaacccttctacaaaaagggaggccaacaagtcaaagccgtccgagtcgaacaagtccagaaatcgggcgtggtagtaagaaacggcaacggagtcgccgacaacgcaagtatggtgcgtgtcgacgtatttatcaaaggaggcaaatacttcctagtaccaatctacacctggcaagtggcaaaggggatcctcccagatagggccgtggtagccgcaaaagatgaatctgaatgggaactcatggataaaaccgctcagttcctcttcagcatgttcccaaacgatctaatccaggtgaagacaaagaaagagactttcttcggatactacaatggccttgacagggccacaggcgcaataaacctcaaggaaccagacagcaacatcaacaagggaaagagcggcctccatcgaagtatcggcgtcaaaaccgcactctccgtagagaaataccaagtcgacgaactaggcaaaaacataaggccatgcagaccgagcaaaagacaagcggtgcgctga

SEQ ID NO: 7266 - RNA, 3147 nt, synthetic construct
  misc_feature 1..3147: note = Cas9 variant
  source 1..3147: mol_type = other RNA
atgaaaagattaggactagatataggcacaaacagcataggatggtgcttaatcgaagacgacggcgacggaaaaggacgaatcatcgacataggagcaaggatcttctcagacgggcgcgaccccaaatcaggggcaagcctagccgtcgatcgcagggctgcaagagcaatgcggcgccgccgtgacagatacttagggcgcaggactgcattcctaaaagcactaaaacgcttcggcctaatgcccgccgacgagtcagccgccaaactactcgcggaccgagacccctacgagctcagggcccgggcactggacgaaaggttggaaccacacgagataggcagagccctgttccacttaaaccaacgacggggcttcaagagcaaccgaaaagccgaaaggaaaaccaaagacgcggaagacggaaaaatagccaacggcgcaaaagccctcgaccaagccatggcagaaagcggtgcagaaacactcggtcaattcctctcgagccgcgacacaaaaagagtcagaatgggatccgacgcccaaggctacgatttctacccccaaagacgccacgtagagtacgagttcgacacaatctggagccgccagcaacaacaccaccccgccctactcaccgaagaagcacggaagaaactccacgacatcctcttcttccaacgccccctaaaagaacaagaagtgggcgtatgtaccttcgtacacaacgaatgcagactcccaaaggcacacccactcttccaagaacgtaggctctacgaagaagtcaaccaactagaaataaccacccccggcgccccaaaccgaaaactcacaatggacgagcgcgacgccctaatcttagaactgcggtcccgcaaagagcgctcctttgactcactagccaaacgcctcaaactcgccccaggtcaatccttcaacaaagcaagcgagagccgaacccggctcagaggagacgaagtatacgcagtaatggcccacaagaaacgattcggagaccggtggcctcacctggacagagacagacaatgggctataataaaacggataatagaagaagaagatccagacaaactgcacgccttcctgacgggcgaatggggactcacagacgaacaagccctcgcgaccgcccgcgcccctctaccggaactctacggcagactaggcccgaccgcaacagcgcgcatactggaagaactaaagaaagacgtcatcacgtacgacgaagcggtccgacgagctggatggcaccacagcgacgatcgaaccggagaaatactaccccaactaccctactacggggaactactcacgcgggacatcccgcccggaacacaggacccgaatgatccaccagaacagagatggggtaaaataacaaacccaacagtacacataggcctacgacaactcgaaaaactggtcaatgcaattatcaaagtacacggacgacccgaccaaatcgtcgtcgaactggcccgagaactaaaactcaatgagaaagacaaggaagaacacaacagacgaatccgccgagacaccgccgccgcgcaactcaggagcgcaaaactgcaatctgaaggcatcccggatacaggagcaaacaggatgttactcagaatatgggaggaacttaacccaggcgaagtcctagaccgacgttgcccctactgcggggagcccgtgggaatgcgcatgctattcgcgggggaagctgacattgatcacatcataccgtactcgagaagcctagacgacagcgcaggcaacaaagtagtagcccaccgaagctgcaaccgagcaaaaggaaatcgcacaccgtacgagaagtgggtacatgaccccgaccgctgggacgtaatctcaacccaggtcgccaggctgcacaagtcaaaacaatggcgctttgggcccgacgcgatggcacgagtagagaaggacggcggcttcatagccaggcaactaacagacacacagtacctctcgcgtctggccgggcgctacctctcgtcactttacccgacaaaagacgacggcagtgtctacgtcatacccggccgtatgaccgcaatgttgcgaagaagatgggggctaaacagtctcctcccagaccacaatttcgtagacaacgaacactcaaacgcaccgaaaaaccgattagaccacagacatcacgccatagacgcagccgtcgtagctgtcacaacccgtgccctcatgcaggaaatcgcacgaaccgcaggacgagccgaagataaagacctagaccgcttattcgaggatctacctcaaccatgggaaggcttcagagaagaacttggcgaaaagctagttcgagtcacagtcagccacaaacctgaccacggaaggaaaggcctcccacccaagaaccgagacgtgacagctggaagactgcacaacgataccgcctacggcctgacaggcgacgtagcagctgatgggaaaacacccatagtggtccacagggtcccattaatgtccctcaaaccagcagacataagcgatcccgatcgtatacccgaccccgcactcagaagcgccctccatagagccaccgatggactcagcggcaaggcctacgacgcagcactcgcaggcttcgcaaaaacccacccccagtttgccggaataagacgcgtcagagttcgcgaaccactcacagtcataccgatcgcggaccgcgacggtagaccctttaaggcttacaaaggcgacgccaacagccgcgttgacatatggagaatgccagacggaaaatggctctccgacgtagtcacaatgtacgaggctcatagaagagaccactcggaccggcgaccccaccccgcagccaagaaactcatgtccctacgccaaaatgatatgatcgccgtagaacgagatggagcacccagacaaataatggtagtcaaacaaatctggccgacccagataaacctagtagaacacaaagaaaccggaaacctaaaagaccgtcattcaaacgagacagatccattcagattcttcgcccccaccgcgggtggacttaagaaaatgaaagcacgccaagtccgaatcgaccctctcggccgcatctttgacccaggcccacgctga

SEQ ID NO: 7267 - RNA, 3147 nt, synthetic construct
  misc_feature 1..3147: note = Cas9 variant
  source 1..3147: mol_type = other RNA
atggccaacatcgcagaaaaccttgtattcggcatcgaccttggaatcggcagctgcggctgggccgtcctcaaccaaaaagccaaagacgaaaacatcgtcgcactcggaagctggtgctttgacgtaccagaaacagacaaggaaagaatccccacaaaccaaattcgacgcgccaacagactactccgacgagtcattcggcgtcggcgaaaccgaatggccgaaatcagaagactcttcgcaagcaaaggaatgctagacacggcagaccccgatgcgttagcgaaaatctcagccgacccgtgggagatgcgggcaaaaggactagactaccaactcacaccgcaagagttcgccgtggccctgggccacatagcgaaaaggcgcggcttcaagagcgccgccaaaagagtatcaaccaatgccccatccgaagacagcaaaatgctcgcggcgctagagaaaacaaaagaacaatccgcacaataccgaaccatcggcgaaatgttcgcccgcgaccccgcatacgccgacagacgacgaaaccgagacggatgcttcgaccgaacaatgtcgcgagaagacctctttaaagaaacccaaatattatttgaaagccaacgccggctcggtaacttcagcgccacatcagagacagaacaagcgttcatagacatagccttccgacaaaagcccatgcaagacagcgaaagactcgtcgaaacgtgcctattcgaaccggacgaaaaacgagcaagccgcttcgccccgagcttcgaaaggtttcgactactctgcaggctagtaaatctaagggtcacagacgggctagaggaccgcccactcaccccagaggaactccgactagcatgcgaggacgccggaaaaaccagaaagctcagcgtcaagaaagtcagaagccttataggcctccgagacgaccaaaggttcaccacaataccccctgatcaagaacaacacgacatagctgcgagaacgggcgacgcgctaaccggcaccgcaacattccgagcaatcctaggagagagtttctggcgccaactcctgcctcacccagaacaactcgaccgagccgcgtggatcatctcattccatgaactaaccgacaccataatcagcaaactcgcaacgatcggactaccctccgaagtcatggaactaattagaaaggccctagaggacggcaaattctcaaaattcaaaggagctgccagcctatccgacaaagcagcaagaaaactaataccgttcctacaggaaggactaacgtacgacaaggcatgccaaaaagctgggtacaaccacgcggcaagcaaatttacccactacgacagtatagacacaaaggcaaagttcaacagtctcatggacgacgtacgggatagcatcacaaatcccgtcgcccgaaaagcgatatcagaaggcatgaagcaagtctgggcaatgcgcaaccaatggggccttcccggagcaatctgcattgaactagcgagagacgtcggcaacagcgccgagaaaagacgcgaaatcgagtcgggcataaagaaaaataccgcccagcgagaacgggaaagacaagaagcaaaagaacacctcaaccaatccgacatttccagcgagaccctcctcaggtaccgactctggaaagaacaaggcggacgatgctgctacaccgatcagcccataacgccatcacaactcatcgcaagcgacaactccgtccaagtggaccatatactgccctggtcccgcttcggagacgacagctacctcaacaaggctttatgcaccgcaaaagcaaaccaagaaaagaaaaaccgaaccccctgggagtggatccacaaccaaaaaggtgtcgaagcatggaaccactttacagcagcagtcgagtcccgaaaagagaccagaggactgaagaaacgaaacttcctcctcaaaagctcaaaagaaaccgaagaacggttccgaagccgaaacttaaacgacacaaggtacgcagcccgagtaatggccgaagcagtccggctcctctaccccagcgggaaccgcgccgaaaaaggcggtgtcaaacgcgttttcaccagacccggagccctcacagccgctctccgacacgcctggggagtcgaatccctcaaaaagatcaatgggaagcgactaaacgacgaccgccaccacgctctagatgccgccgtagtagccgcagtatccgaaaaagaaatacaaaagctaaccaagagcttccaaatctgcgagcaaaaagggctagctcgcccaatgagagacgtacccatgccctgggaagggttcagacaccagttagagacggcatacgccgacatacgagtagcgcgcccagagagacgtagagcgagaggtaaagggcacgacgccactatacgacaacttcgcgaagaaaaagacggccccgtggtctatgaaagacgagcgataagcgacttaaaactaaccgacctggagcgaatcaaagacccagagcgcaactcagctataatcagcagcctgaggacttggatagaaaaaggcaaacccgccgactatccaccacaatcccccaagggcgacgaaatacgaaaaatacgagttatgtcgcgaaacaaacccgccgtaagcgtgcgcgggggcaccgcggaccgaggagagatgacaagggtagatgtcttcaccaagatgggaaagaaaggaaaacccgaatggttcttagtcccaatctaccggcaccaagtcatcgaccgcatccaatggccacaacccccaaaccaagcagcggcaaacggaaaatcggaaaagaactggcccaccatgggcctcgaacacgagttccgcttcagcctgtaccccagaagctacgtccagatagtcaagcgcgacggagaaatcatagaaggctatttcgcgggtcttgaccgaaccgtcgcagcgttcagtctattatcaagctcagaccccacgagcatccaacgaggcatcggcgccaaaaccttagaatcaatccgaaaatacaacgtcaaccggttcggcgacatcagtatggtagaacaggaaacacgaacctggcacggcgacgtgtgcatatcaccagaccaacccgactcggcctga

SEQ ID NO: 7268 - RNA, 3147 nt, synthetic construct
  misc_feature 1..3147: note = Cas9 variant
  source 1..3147: mol_type = other RNA
atggtcgagaaaatattagggatagaccttggcatatcgtccttaggctgggcggtcgtcgaatacgataaagataacgacgaaaacaacaagataattgactgcggcgtacgactcttcaccgctgccgaaacccccaaggaaaaagaatcccctaacaaagcccgcagggacgcccggggactccgccgcgtcatcaaacgccgccgcgtacgaatgaacaccatcaaaaacctcctcatcacctacaaactgatcgacaagaccctcctcgacgaagaaatgggcatgttccactcccaaagtaacagagtggacgtgtggaaactcagacacgacgccctataccaccttctgagtggggacgaactagcaagagttctcatccacatagccaaacacagagggtacaaattcctaggagatgacgaaagcgacgaagaatcaggtaaggttaagaaagcaggcgccgagcttaaaaagaaattcctcgaagccggatgccagtcagtcggcgagtggctgtggaaagagagaggactacaggggaagaaaaggaacaaatcaggcgactacgaaatctcgataccccgagacttcctagtcgaagagatccagcgtatcttcgaaacacaacagaaattcggatccacattcgcaacatccgaactccaaaaagcgtacacagacatagcgttctatgtaaaaccgatgcaatccatcgaggacatggtcggctactgcaccttctacccaaaaatcaagtccaaaaaccaagatggggagaaaagggcacctaaagcctcgccatcagctgaacaattcgtcatactctccaaaatcttttcgaccatcgtcatcgacgaaaataaacaggagaaaaagctcatcgaactgaaatctatagaacaactgatccaaatcgccagaagcaaagagaccctgaaatacaaacaactacgaaaagagctgaacctggccaaagacatatcattcaaaagcatatccgacgaagagaagacctggatcaacctagtaggcaacgcgaaattcaagaaaatcctaggcctaaactacgaaacattcctgaaaaacacagagatcagcgacgagatcgccaaaatcctcacatacgacaaaacgttcgaacaaaaagagacgaaactgaaaaacctcctagtaaacatcgactggatcgacaacaaccacatcgcggaactggccaagctgagcttcagccagttcaaccaactaagcctcaaagccataaaaatcatctcgaaaataatgatcgaggggtacgcccgttacgacgaggccgtccaatacgccttcgaaaacaatcttctccccaagccatcgcacgaaaagagcatcctactaccccctcttaaagagaccaacatcgcaatcctcaacccaaccgtcattcgagcatttgcccaattccgccaagttgccaacgccctagtgagcaaatacggttccttcgacaaagtgcacttcgaactcgcacgcgaagtaaacaccaaggaagaccgcaaacgctgggagaaggatcgcgacaagaatgagaaaatgcataggcaaatcaccgaaaagctagtggaagagggagtcaaacccagctacaaaaacatcctcaagtccaagctacgaagcgaacaaaaagatacctgcccctactgccaaaagaacctccactaccccatgatcttcgaggacggatatgccgagatagaccacatactaccactcagccaatcgcaagacgacagctacgtaaacaaagtcctagtccattccgcatgcaaccaaaacaagaaaaacaggacaccctttgagtggttccaggacgaaaagaaagactgggacaccttcaaatcatacatcctgatggaatcaacactcggagaaaagaaacgcaactaccttatcaaagaaaacttcagcgacccccaatcccgcaaagaatttatctcccgcaacctcaacgacacgcgctacatgagcaaagcgatcaaaacatactgcgagaaccactggaaactaagccacgacgatgacaaactccgaatacaagtaagatccggaaaactaacgagtaccctccggcaccaatgggggctagataacaaaaaccgggaaactcacacgcaccacgcaatggacgcaatcatgatcgctttctcaacccaaggcatggtcaagaaactaagcgactacttcgccaagaaagaagcaaaagtagaaaaagacaaaccagtactcatcacccccataaagcaattcaaagaagcagtcgaacaagccaccaccctcgaacgccaagagtcgatacaaacgaaagctggagataccatcacgctcaaccgcctcctcatctcccgacccccaagagcatccgtgaccggagcggcccacgaacaaaccgcgaaaccttaccccagaatcaaacccatcaaaaacaaatacaagcgacgccgcatacccatcgacgaggacaagttcgagctgttccgtaacgacaaagtggcctctggcaacgacaaaaatttctacaactcaagcaccatcccccgggtagacatctacaagaaggatgacaaataccacgttgtaccaatttacctctcagatatgaccaaagccgaagtccccaacaagagtttaggaaccaaccccgaagggatggacgaaaaatacttctgcttcagcgtcttcaagaacgacctaatagaacttgaaactaaagccacccccaaaaagccctccaagaagctcctaggatacttcaaacagttaaatggagcaaacttcatcctcaatagcatccacaatggcataatcgacggtttcgtgtgtagcccaatcaccctcttcaaacagcaaaaagacatgtgcaagaaatgcctcccggaagatcgggccattggcaactgttcccaagaaacactagagttctgggaagcagaaaacataaaagtcccaaagaaagacttcgaatgtgaccaaggtatcaaattcgccatagcagtccgaaaatacaccatcgaccctctcgggtactaccacgaagtaaaaggggaaaaactcctcggcacgatcccccagggcgccaagaaacacccgaaacgccaaaagtga

SEQ ID NO: 7269 - RNA, 3150 nt, synthetic construct
  misc_feature 1..3150: note = Cas9 variant
  source 1..3150: mol_type = other RNA
atgataaatgaaagactcaccttcgggatagacctcgggatcggaagctgcggatgggcagtgctacgccacgcagacgcagcgggagaacccggggtgatagagggactagggagctggtgcttcgacgtccccgaaacgtccaaagagagaatacccaccaatcaggtacgcaggagcaacagactgctccggagagtgattcggagacgtcggaatcgaatggcagaaataaggcgcctgttccacgcgcaggggctactgccgtcagccgacgaagatgccctaaaaagaccacgcctggacccgtgggaactcagagcaagaggactggaccaatgtctatctgcagaagaatttgcagtcgccctaggacacatagcgagacaccgggggttcagatcgagcgcaaagcgcaaagcggcaaacacatcgggcgaggactcaaagatgctctcagccctgttggtcacacgggagagaaccgcacgatatagaacagtaggagaaatgtttgcccgggatccggaatactcagcacgacgaaggaatagggacggaatatttgacaggactgtagcacgagacgacctaatacatgaggtaggcaaactgtttgaggcacagcgagcacgcggatcagcattcgcaagcccagacctcgaagcagacttcaatgccatcgcattccgccaagcggaaatgcaagatagcgaaaggctggtagggaactgcccattcgaacgggacgaaaagagagcggcaagatgggcgccgagcttcgaaagattcagattattgaccaggctcatcaacttacggatagcaacagcagaaggggaacgcagattcacaccagaagacctagcacgcgtaagcgctgaactaggcgccacagccaaactcccggtctcgcgcgtgagagcgctaataggcctgttaccggacgagagatttacaacgataagagtagaggacgaagacagagacatagtagcaagaacaggtgaggccgcgccagggacgtggagacttaggaaaaccctcggggaagcattatgggcggaaatgcaagcccgacccgaccaactagacgcaatcgcacacgtactgagcttcttcgaggcgacggcgaaaataagaagcgaactagaccgccttggcctgccagccgcagtcatcgaagcactcgacagaggcctagaagacggagcgtttgcaaaattcaaaggagcagggcacataagcgcgaaagcatgcagaaacctcctgccgcacctacaacagggccaccgatacgaccaagcctgccggctagccggctacgaccacgctgcgagcacgctgagccataccgcacaagtcgtcagtaaagcgggcttcaacgcgctagtgactgagctaggagagagcatcgccaacccgatcgccaggaaagcactaaccgagggactaaaacagatacgagctatgtgtgcaagatggggcctacccggagcaatacacatcgaactggccagggaagtcggcaatagtatagaaaaacgcagggagctggagtcacaaagagaaacgacaacgaaacggcggcaaaccgaaagagacgaaatcaggggactcttagcactagaagacgtcgacgacgacacattgctaagataccgcctgtggaaggaacaaggcggcaaatgcctttacacaggaaaggacatccatgtgcgacagctaatagccacggacaacagcgtacaagtggatcacatactgccatggagccgattcggcgacgacagcttcaacaacaaaacgctctgcctcgcgagcgccaaccagagaaaaagaggccaaacgccctgggaatggttctccctgacaggcacgccggaagcgtgggaggtcttcgcgagcagggtagaaacctcgaaagatctaaggggatttaaaaagcgaaacctcctattaaagaacgccgacgaagtcgcacaaaggttcagaagccgaaacctgaatgataccagatacgcggcacgcctgctcgcagaagcagcgaaactgttctaccccgcaggcgaccggcaagaaaaggacggcagaagacgcgtcctaacacgaccaggacctcttacagccgccctcaggcacgcgtggggactcgagagcctaaagaaagcggacggaaagagagtgagcgacgaccgacaccacgcactggacgcattggcggtagcggcgatatcagaacgagaggtacaaagattaacaaggagcttccaggagtgggaacaacaaggactggccaggcctctacggcacgtagcgccgccgtggcccgggttcagaggggacgtgctagctgcatacgcacaggccttcgtagcacgaccagagaggagaagggcgagaggcaaaggacacgacgcaagcataaggcaagtcgtaggggaaggaccagaagcccaggtgttcgagcgaagaggactggctgatctgaaagaagcagacctagaccgggtgaaagacccggaaagaaaccaggcaataatagaggcagtgcgcgcgtggatcctagccggaaggcccgccgacgccccaccgcggagcccaaggggagacgtgatcgtaaaattgcgaacggcgccggccaagaaaataaaaccagcagtgccagttcggggaggaaccgcggaccggggagacatggtaagaatagacgtattcacacgaccaaaccgaaaaggccgggacgaatggtacctcgtcccaatatacccacaccaagtcatgaacagaaaggcctggccacacccaccaatgcgtagtgtggtcgcatataaagacgaggccgggtggactgagatcggcgcggaacacagtttccgcttttcgctctacccccgaagctacgtgcaactggtaaaaagtaatggagacgtcatcgaggggtacctggtgtcaatggaccgaagcacgggagctttccgggtgttcgtgcacaacaacccagccgagatggcgaagggaataggagcgaagaccctgctcaacctacgaaaattcaacgtagacaggttcggcgttagaacagaagtaaagagcgaagtcaggacctggcacggggaggtctgcacgagcccagtaccacccgattga

SEQ ID NO: 7270 - RNA, 3150 nt, synthetic construct
  misc_feature 1..3150: note = Cas9 variant
  source 1..3150: mol_type = other RNA
atgcaactctcaaaacttaactacatcctcggcctcgacctaggcatcgcatccgtcggctggtccgtaatcgaaatcgacgaaaccgaaatgcctattcgcctaatagacgtaggcgtacgcaccttcgagcgcgcggaagtgcccaagacgggagaatcgttggcactagctcgacgcttggcccgatcgactcgcaggctcattcgccgcagagcattcagactccttaaggcaaaacgcctactcaaaaaccaccaaattgtatccgcggacgaactatccacactaccaaatcactgctgggaactcagggtgaaaggactcgacgaacgactaacctgccaagaatgggccgcagtcctcctacacctactaaaacaccgcggctacctctcccaacgaaaatcagaagcccaaaacgcggacaaagaaatgggagcactcctgtcgggcgttgcgaacaaccacaagctcctcagcgaaaaccactacagaactccagccgaaatagccgtcaagaaattcgccctggaagaaggacacatgcgaaaccagcgcggcgcgtatacacacacattcaaccgcctcgatcttctggccgagatgaggcttcttttccagacacaacgcgaactaggaagcccctacgctagtggcgaactggagcaggagttctgcaaactcctaatgtggcaaaaaccagccctctccggtgacgccatcctgaaaatgctcgggaagtgtacactcgaaccaaccgaatataaagcagcgaaaaacacatatacggccgaacgcttcgtatggctcacaaaacttaacaacttgcgaatcctagaaaatggtagcgaaagagcactgaacgcagacgaacgcgcgctacttctcaaccaaccctacgaaaaggcgaagttcacatacgaacaagcaagaaaacttctacaacttaacgaagcagctaggttcaacagcgtcagatatgggaaagaaaacgccgaaaagagcacactaatggaaatgaaggcttaccacgccatacgaaaagccgtagaaaccgcagacagcagtgcatgggccacactcaaaacccaacccctactactcgacgagatcggaacagcgttcagcatctacaaaacagacgaggacataaaaacgcaacttcaaggcaagttagccgacaacgtaatcgacgttctgcttgaaaacctaaacttcgataagttcatacagctgtcactaaaggcgctgtacaaaatactccccctaatggaacagggactccgctacgacgaagcatgctcccaaatatacggcgaccactttggcaaaaaggaacagaaaaacgatcggctcctgccccaaatcccggcggacgaaatccgaaacccggtcgtcctccgcaccttgagccaagcacgaaaagttatcaacgccgtaatccgcctatacggatcccccgcacgaatccacatagaaaccgcccgagaactgggcaaatcatacaaagaccgcaaagaaatagagaagcgccaagaacaaaaccgagcagagcgcgaaaaagccgtagacaaattcaaagaacttttccctaactttataggagaacccaaagctaaagacatcctaacaatgcgactctacgaacaacaaaacggtcagtgcctctactccgggaaaagcctagacctacaccgcctcctcgaaaaaggatacgtagagatagaccacgccctaccattttcacgcacctgggacgacagcttcaacaacaaagtcctagtcctagcgggagaaaaccagaataagagtaaccagaccccatttgaatggctcggaaaagatgagcaaaagtgggcactattcacggcccgcgtcaactcgtgccggttcccctactccaagaaacaacgcatcctaacaaagaagttagacgacgaagggtttatccagcggaacctcaacgacacaagatacatcgcaagattcctagtaaactttgtcaacgacaacctacacctaacagggaaaggaaagagacgagtgttcgcgtcgaacgggcagattaccgcattcctgcgcggccgctggggcctcacgaaagtccgcgaagaaagcgacaggcaccacgccctagacgccgtagtagtagcgtgctccacagtcagcatccaacaaaagatcacccgctttgtcaaataccaggaaggcaacctccagaccgccgagcgaatagaccgagagacaggagaaatcatcccactacacttcccggacccatgggctttcttccgggaagaggtaatgatccgcatcttcagcgaaatgccccaagaagacctggtcatcaaactcccagacagaccacaggcaaaccatgagtttgtgcaacccctattcgtatcacgcatgcccacacgaaaaatgtcgggacaaggccacatggaaaccatcaaatccgccaaaagactggacgaggggatcagcgtcagcaaagtaccactaacccagctcaaactgaaagacctcgaaaacatggtaaaccgagaccgagaaatagcactctacgaagcactcaaagccagacttacagagttcaaagacgacccagcaaaagccttcgctgaaccattctacaagaaaggaggagtccaagtgaaaagtgtgagagtagagcaagttcagaaaagcggagtggtagtacgcaacgggaacggcgtagcagacaacgcaagcatggtgagagtcgacgtattcatcaaaggcggcaaatacttcctcgtccccatctacacctggcaagttgccaagggcatcctcccggatcgagcggtcattgcctacacgcctgagaacgaatgggaactgatggacgactcagcccaattccagttctcaatatatccaaacgacctcataaaattgaccaccaagaaggccatcttcttcggctactattccgggttcaaccgactcaccggagccatcaacatcaaagaacacgatctacagataagcaaaggggataaaggggtacacctcgggctcggagtcaaactggcactaagtttagaaaaataccaggtagatgaactgggcaagaacatacgaccatgccgacccacacaacggcaaaacgtacgctga

SEQ ID NO: 7271 - RNA, 3153 nt, synthetic construct
  misc_feature 1..3153: note = Cas9 variant
  source 1..3153: mol_type = other RNA
atgtctagctatcggttctccttcgacctaggaaccaactcaattggttgggctgtattcgaactcgacccaaaaacaagaccagtagcactagcagactgcggcgtgcggatcttccctgacggacgaaatccaaaagacaaacaaagcctagccgtcgcccgtcgagaggcacgcgctgtcagacgccggcgagaccgatatctgaaaagaagatccgaacttatggaacgactcgtagcaaaaggactaatgcccgaatcaagagacgaccaaaaagctctagaaggcctcgacccatacgcactgcgggcagccggcctagacgacgcgttacccccacaccactttgggagagcactcttccacctaaaccagagacgtggatttaaatcaaaccgtaaaacagaccgcggcgagaacagcgaaaccggaatcacgaagataggaatgaagaaactccacgaggcgctactatccgaaggctgccgaaccctaggcgaactacagcaccgacaccacgaagccaaccagacaccggccatggataccaaccccaaatcagtcagaagtaaactccgaggcgaaggcgccaaagccgtatacgatttctacccaagtagggacgccgtggaagacgagttcaacaaactatgggactctcagaaaaggttccaccccgacctattaacagattcagcacgggacgcaatacgagacgccatcttctaccaacgtaaactcaaaacaccagacgccggccgctgcagcttcaaccccgccgaagaacgtgtcgcgcgagcaatgccaatcgcacaacactttcgcatcctacaattcgtcggggaccttcgcctcatcgacaacgacctcgttcgacacccgctcaacaacgatcaaaagaaagcattgtaccgagacctactcgcaaaagggaaactaaccttcaaagcgatgcgcaaaacaatcggcatcggctcagaatacgcattctcacacgaaagcgaaaaacagagcgagttcaggggcgacgaaacagcagcaagactcgccggacccaaatacttcggcccaaagtggcgagaactctccttcaatgaccagagcgaaatcgtcgacagactcctacacgaagaaaacgaagagaccctgatacaatacctacaagacagattcgggtttgaccacgacaggtgcgaagtaatagcagacgccccattgccggacggccacactcggctcggcaaaaccgcactcgaaaccttagtagaaataatgagagacgaccacctaccctacgaccaggcctgcacgaaagccggctacgaacacgcattacctcctgacggcgtaatactagacgaccttccatactacgggatagcactagaacgccacgtagcattcggagatggaaaatcagaaaaccccgaaaaacgctacggaaaaatcgcaaaccccacggtacatatagcgctcaatcaactacggaaggtgattaacgccctaatagcaagatacggtcaccccgatcaagtagtaatggaaattgcccgcgacctgaaacaatctaaagcgaaaagagacgacatcagcaaagaacagaaaaagaaccaagaccgcaacgaccaacgcagaaagaaactccaagaagcacacatcgccgttaacgcggaaaacatgctccgcatgcgcctgtgggaggaactcgacgaagacaacgccgcggcacgcgcctgcccattcaccggagagaccatctccatggcacgcctcttctcaccagaggtcgaaatagaacacatcctccctttttcacgttcactagacaactcacccgccaacaaaacattatgcatggtctgggcaaatcgagccaaaggcaacaggaccccgtgggaagcgttcggccgggacagggaaccgggctttgactggcccgaaatcgcagcacgcgctgcacggctaccgaaaaataagagctggaggttcggtccagacgccatggaaagactggaaagagagggcgactttctggaccgccaactcaccgacacgcaatacctctcacgcatagcaagagaatacgtcacaaaaatctgcgaccccaaccaagtgtgggtaacgccgggacgcctaacggcgtggctacgccgcaactggggactcaacggcattctcccgaccggcaacgcgactaaaaaccgggacgaccacagacaccacgcaatagacgcaattgtcgtaggcctaacagaccgaggaatcctaaacagagtaagccggagcgcggcactcgccgaagcagaagatttagaccgaagcatagcggaaatgcccgaccccttcgacggcttccgggacaacatccgacacatactggaacaaataatcgtatcgcacaaacccgacgcaggattcgtccccggacaccctaaaggaaacacaacaccaggtgcactccacaacgacacagcatacggcatcatcaaaacagacgcaaaaggcatgtcagaagtagtgacgcggaaggacgtactctcgtttaagggcaccaaagagatagagagcataagagacgcggcaacacgacaaagcctactggacgccgtcgccggcgttccatcaggactggccttcaaagaagcgctccgagattggtcggtccgaactgggacgaaacgagtccgagtcacattcaacatgagtgtcatcccgatccaagacagagacggaaaagcctacaaaggatacaaaggagatggcaacctctgcgcagaaatctacgaaaggcccgacggcaaatggggcgatgaaatcatcagccgattcgacgcagtccaaccaggcttcaccccacaatggcaaagagaccatccggccgcccacagagtcatgcgactattccgcgacgacatgatcatggccgaaatagacggcgtaatgaccgtctgtcgaatagtcaaaatgtcaccaggcaaagtcgtcttcacgcctcatcacgaagcaaacactgactcacgaaaccgcgacaaagacgaccccttctccttccatacctgctcgggagaatcgttacgcaaaagaaaagcccaaaaactattcgttgaccctctcggaaaaatacgaggttacagagcaaaggaaggatga

SEQ ID NO: 7272 - RNA, 3153 nt, synthetic construct
  misc_feature 1..3153: note = Cas9 variant
  source 1..3153: mol_type = other RNA
atgggagagaacatgatagacgagagcctgacgttcggcatcgacctaggtatcggaagctgcggatgggccgtcctaagaaggcccagcgccttcggaagaaagggggtaatagaaggaatgggaagctggtgcttcgacgtaccagaaacaagcaaggaacgcacgcccacgaaccaaatacgcagatcaaaccggctccttcgcagggtaatcagaagacgccggaaccgcatggcagccatccgtcgactcttacatgctgccggattactcccgagtacagacagcgacgcgctcaaaagaccaggacacgacccatgggaactacgcgcccgtggactggacaagcccctaaaacccgtagagttcgcagttgtactaggacacatcgccaaacgccggggattcaaaagcgcagcgaaacgcaaagccaccaacataagcagcgatgacaagaaaatgctgaccgccctagaggcaacacgcgaacgcctcggacgataccgcacagtaggagaaatgtttgccagagatcccgacttcgcatcccgaagacggaatcgagaagggaaatacgacaggacaacagcccgagacgacctcgaacacgaagtccacgcactattcgcagcacaacggcgcctcgggcaaggattcgccagccccgaactagaagaagcctttaccgcctcggcctttcaccaacggccaatgcaagacagcgaacgcctcgtgggattctgcccctttgaacgcacagagaaaagagcggcgaaactaacaccatcattcgaacgcttccgcctactagcgcgcctactcaacttgcgcataacaacgccagatggagaaagaccactaaccgtagacgaaatagcactcgtcacacgcgacctcggcaaaacagccaaactatcaatcaaacgcgtccggacactcataggactagaggacaatcaacgattcaccacaatccgcccggaagacgaggaccgagacatagtcgcaagaacaggcggcgcaatgacagggaccgcaaccctgcggaaagccctcggagaagccttatggaccgacatgcaagaacgccccgaacaattggacgcaatagtgcaggtactctcattctttgaagcaaatgaaaccatcacagaaaagctaagagagataggcctcaccctcgccgtcctcgacgtactgctaaccgccctagacgccggggtattcgcaaagttcaaaggcgcggcccacataagcacgaaggcggcgagaaacctcctcccacacctagaacagggacgaaggtacgacgaagcatgtaccatggccggctacgaccacgcggccagccgactatcacaccacggtcaaatagtcgctaaaacacaattcaacgccctagtaacggagatcggcgaatcaatcgcaaacccaatcgcaagaaaagcactcatagaaggacttaaacaaatatgggctatgcgcaaccactggggccttccaggatcgatacacgtagaactcgcgagagacgtaggaaacagcatagaaaaacgaagagaaatcgagaaacacatcgagaaaaacacggccctccgcgctagagaacgacgcgaagtacacgacctactggacctcgaagacgtcaacggcgacaccctacttagatacaggctatggaaagaacagggaggcaaatgcctatatacaggcaaggcgatccacattcgacaaatcgcagcgaccgacaacagcgtacaggtagaccacatcctcccatggagccgttttggggacgacagcttcaacaacaaaacgctatgtctagctagcgcaaaccagcagaaaaagcgcagtacaccatacgaatggctatccggacaaacaggggacgcctggaacgcattcgtgcaacgaatcgaaacgaacaaagagctaagaggattcaagaaacggaactacctcctcaaaaacgccaaagaagccgaagaaaaattccgatcaagaaacctaaacgatacacgctacgcagccagactattcgccgaagcggtcaaactactttatgccttcggagaaagacaagagaaaggcggaaaccgccgcgtattcacaagaccgggagccctgacagcggccctacgccaagcctggggtgtcgaatcactaaagaaacaagacggcaaacgcataaacgacgaccgacaccacgctctggacgccctcacagtcgcggcagtagatgaagccgaaattcaacgcctaaccaaatccttccatgaatgggagcaacaagggctaggacgccccctgcggagagtcgaacctccgtgggaatccttccgcgccgacgtcgaagcaacatacccagaagtgttcgtcgcacgcccagagcgcagacgggcccgcggcgaaggacacgccgccaccatccgacaggtcaaagaaagagagtgcacacccatagtattcgaaaggaaagcagtcagcagcctaaaagaagccgacttggaaagaataaaagacggagaacgaaatgaagctatcgtagaagcaataaggtcatggatcgccacagggagaccggcagacgccccgcccagatcccccagaggcgacattataacgaaaatccgactcgcgaccacaataaaagctgcagtacccgtaaggggcggaaccgccgggcggggagagatggttcgagcagacgtcttttcgaaacccaaccggaggggcaaagacgaatggtacctagtaccggtatacccgcaccaaataatgaacagaaaagcatggcccaagccaccaatgcgcagcatcgtagcaaacaaagacgaggacgagtggacagaagtaggaccagaacaccaatttaggttctcactgtacccccggtctaacatcgaaataatacgaccaagcggcgaagtcatagaaggatacttcgtaggactccaccgaaacaccggcgccctcaccataagcgcccataacgaccccaaatcaatccacagtggcataggcaccaagacacttcttgccatctcaaaatatcaagtagaccgattcggccgaaaaagccccgtgcgaaaagaagtaagaacctggcacggagaggcatgcatatccccaacaccgccaggctga

SEQ ID NO: 7273 - RNA, 3153 nt, synthetic construct
  misc_feature 1..3153: note = Cas9 variant
  source 1..3153: mol_type = other RNA
atgaagatacttggcttcgacatagggatagcaagcatcggatgggcgttcgttgaaaacggtgaactgaaagactgcggagtaagaatattcacgaaagcagaaaaccccaaaaccggtgactcgctcgcaatgcctcgacgagaagcacgttcggtacgccgacggctggcacgcagaaaaggccgcctagaaaccctcaaacgactcctcgccaaagaatgggacctatgctacgaagactacatcgccgccgacggcgagctccccaaggccttcatgggcaaaaacctcaacaacccatacgtcctacgctacgaagcactacaacgtcttctctccaaagaggagctagtccgcgtcgtgctccacatcgcaaaacatcgggggtacggaaacaagaatgccaaaatcacgaaaagtgaagaatcgaaacgggagcaaggtaaaatactatccgcgctcgctacgaacgcatccgcaatagcaaggtaccggaccgtgggagaatatttctacaaagagttctgtgaagtcatcaaaaacccacaagggctgagcacaaacgaacactatacccaaagcaaggtccgggtcctaaaacccatacgtaacaagggaggagaatacacgaactgcatccttcaggaggacctccagcgcgagctacgctgcatattcgaatatcagaaaggattcggctttcccatcacccaggaatttcaggacaagatcctcaagatcgccttctaccaacgccccctcaaagacttcagccacctcgtcggaaaatgcaccttctaccccgatgagttcagggctctaaaatgcagcctgtccgcagtagagttcataaccctgagcaaaacaatcaacgtcctcacatacatatccaaagaaagcggggaagtatactccaagggccaatacgaacaaatgctcgactcagtgttcaaagcagtatgcgaaaagggctccctcagctttgcccaactacgcaagatactgcacatagacgaaagaatccgatttaaggaggtagactacatggcccgaaagagtaaaaatacatcaggagacagcacccacaaacagaaaacgagcaaccctgaaactaagaaattcatcgaacacaaaaacctcaagaaattctgcgaaatcctgagcgaaatagccgaggacagagcactcgccgacagcatcgcccgcgacatgacgctaattaaagacgaggaaaaactcgctcaaaaacttcacggatacggcaaattctcacaagagcagataacccagctcagcgcccttaacttctcacaccacatcaacctctccctaaaagcccttagcgagatactcccattcatgagagaaggcatgagatatgatgaagcatgcaaactagccggactcaaggcaagacacaacgacaaaaagagtaagttcctacccccattctgcgagtctatatacgccgacgaactgaccaaccccgtagtacaccgagcaatcgctgaataccgcaaaatactcaacgcactaatcgccaaatacggatccgtccacaaaatccacatcgagctaacgcgcgacgttggcaaaaacttccaagaacgcgaaaagtacaagaaagaaatagagtccaactacaaagcgcgcgtccaagccatgcaagagtgcgaaaaactaggactaacgctctccgaggggaacatcctcaagctaagacttttccgcgaacagaacgagatctgcgtttacagcggccgcaagataacccttgccaacctcaaggaacaaggcgcccttgaaatcgaccacatactcccctactcccgcagctccgacgatagctatatgaacaaagtactggtgttcaccaacgagaaccaaaacaaaggaaacaaaaccccatatgaagcattcggaggagactcccagaaatggggagagatcgaatccctagcactacgctcaggctaccctaaaaagaaagcgaaaaggatcctcgacaaaggattcggcgaccgcgaagcaggatttaaaagcagaaacatagtagacagcggctacatcgcacgcctgatcgccaactacacaaaggaatatctaaagttcctcccactagactcccacgagaacaccgcactcattgccggcgaaaaagatagcaaaatccacgtggaggccgtcaagggaatgcttaccgccaccatgagacatttctggggactgggcagcaagaaccgatacgaacatacccaccacgccgtcgatgctatcataatagcctacataaatgctgcaatgatccagcgcttctcccagtttcggcaaaaccaagaatccctaaaagcacgattctacgcgaaagaactagccaaagaagagttcaaaacccaacgcgcattcttcgaacccttccggggcttcagagagcaagtcctagccaaagttggacaaatcttcgtatcccggcccccgcgaaagcgagcaagaggcgccctgcacgaggaaaccttctactctatagacgacaagaaactctctgaaacatacggcggcaaagaaggcgtccagcgcgccctgtctctcggaaaaatccgacaaatcgggacaaaaatcgtcgccaacggccctatggtccgggtagacatattcaaacacaaacagagtcgccgattctacgccgtcccgatatatacaatggacttcgcacttggcatactaccaaacaaagcagtcgtcagcggcaaagacaccaaatcgaaagtaatcaaggactggctcgaaatggactcctgctacgagttctgcttctcactatttaaagacgacctgatcgaagtccagaaatcagacatggagaaaccggagctggcctacttcgtatccctcgacgcatcggacggccggataaaggttcggcaccactgcaacgacatcacaaaaatcaacgaaaaccagaaaaagctattctccgaagccatagaaaaggaggtcgtcgggcgtggctccatccaaaatctgaaagtcttcaaaaagtacaaggtcagcccacttggcgagatcaaagaagcaaaatatgaaccacgtcaaccaatagcactcaaaaccagcccaaagaaacaccgaaaacaaaacaacgcccaatga

SEQ ID NO: 7274 - RNA, 3156 nt, synthetic construct; identical to SEQ ID NO: 1474
  misc_feature 1..3156: note = Cas9 variant
  source 1..3156: mol_type = other RNA

SEQ ID NO: 7275 - RNA, 3159 nt, synthetic construct
  misc_feature 1..3159: note = Cas9 variant
  source 1..3159: mol_type = other RNA
atggagaataaaaacctgcactacatcctgggactagatctcgggatagcctctgttggatgggcagttgtcgaaatcgacgagaaagaaaacccgctccgcctcatcgacgtaggcgtacgcacattcgaacgcgcggagacccagaaaggagagagcttggccctctcgaggcgcagcgcaagaagcgcacgcagactcacacagcgcagagtcgcccggctcaagaaagcaaaaaggctcctcaaaagcgaaaacatcctcctctccaccgacgaacgcctcccacatcaggtatggcaactacgagtggaaggactagaccgtaaactggagcggcaggaatgggccgcagtcctactacacctaatcaagcaccgcggctaccttagccagcggaagaacgaaagtaaatcagaaaacaaggagctaggcgcactgctcagcggagtcgcaagcaaccacgaactactccagcaggcaacctatcgaacccctgcagaactcgcagtaaagaaattcgaagtcgaagaagggcacatcaggaaccagcaaggggcctacacacacacattcagcagactggacctcctcgcggagatggagctcctcttctcccgccaacaacacttcggcaacccatttgcaagcgaaaaactcctcgaaaacctcacagcactcctcatgtggcaaaaacccgccctatcaggagaagatatactcaaaatgcttggcaaatgcacattcgaggacgaatacaaggccgcaaagaacacctacaccgccgaacggttcgtatggatcacaaaactgaacaatctccgcatacaagaaaacggactcgaacgcgccctttcagacaatgagcgcctaatgctcatagaacaaccatacgaaaaggcaaagctaacgtacgcacaagttcgcagcatcttgaacctaagcgacgacgccatattcaaaggagtcagatactcaggagaggataagaaagcaatagaaacaaaaacaacgctaatggagatgaaagcataccaccaaatccgcaaagtgctggaaggaaacaacctaaaagccgaatgggtagccctcaaggcaaatccaaccctactagatgaaatcgggaccgcattcagcctatacaaaaccgacgaagatatcagcgcctatctggccggaaagctcagccaaccagtactaaacgccctcttagagaacctgagcttcgacaaattcatccaactctcactaaaagccctatacaaactgctcccccttatgcaacaaggactcagatatgacgaggcatgcagagaaatatatggtgaccactacggcaagaaaactgaagaaacccatcacttcctaccccagatcccagcggacgaaatccgaaacccagtggtcttgcgcaccctcacccaggcacgcaaggtcataaacggcgtagtccgcctctatgggagccccgctcgcatacacatcgagaccggaagagaggtcggtaaaagttacaaagaccggcacgaactgaaaaagagacaagaagaaaatagaaagcaacgagagaaaacaatcagcgaaatcaaaacactattcccaaacttcagcggcgaacccaagggaaaagacatactcaaaatgagactatactaccaacaaaacgcaaaatgcctatacagcggcaaaccactggaactccatcgactgttcgaacaaaaatacgtggaagtagaccatgccctcccactcagccgaacctgggacgactccttcaacaacaaagtgctcgtgctcgccaacgaaaaccaaaacaaaggcaacctaaccccgttcgaatggctcgacggcaagaacaactcggaacgatggagaaccttcaaagccctggtcgaaacaagcgccttcccctacgccaagaaacaacgtatattaagtcaaaaactcgacgaaaaaggcttcatcgagcgcaatctcaacgacacacgctacgtagcccgattcctgtgcaatttcatcgctgacaacatgcatctcacaggcgagggcaaaagaaaagtattcgcctccaacggccaaattaccgccctactccgaagacgttggggactagctaaaagccgagaagataacgacagacaccatgcgctcgacgcggtcctggtggcctgcagcacagtcgcaatgcaacagaaaataacacgcttcgttcggttcaaagcgggcgatgtcttcaccggcgaaagaatagaccgggaaacgggagaaataataccactacacttccccaccccatggcaattcttcaagcaagaggtcgaaatacgaatattctccgacaacccgaaactagaactcgaaaaccgcctgccagatcgcccccaagcgaatcatgagttcgtacaacccctgttcgtatcgcgaatgccgacaaggaaaatgaccggccaggggcacatggaaaccgtaaaatccgccaaacggctaaacgagggaatcagcatgatcaaaatgccactcaccaaacttaagctcaaagacctggaactaatggtaaatcgcgaacgagaaaaagacctctacgacgcattaaaaacccggctagaagccttcaatgacgaccccgcaaaagcattcgctgaaccattcatgaagaaaggcggagccatcgtcaaatcagtacgtgtcgaacaagtacaaaagagcggcgtactggtccgccaaggcaatggagtggcagataacgccagcatggtcagggtcgacgtctttaccaaggacggtaaatacttcctcgtgccgatatacacatggcaagtcgcaaagggaatactaccgaacaaagccgtcatacaaggaaaagacgaagaagactgggaagacattgacgacgccacattccagttctcgctacaccccaacgacctgataagcgttaaaaccaagaaagacgagttcctaggctactttaacggactcaaccggcacacaggcggcatcaacatcagaacccacgacctagagaaaagcaaagggaaacaaggaatcttcgaaggtattggagtcaaaatagcactgtcattcgaaaaataccaaatcgacgagctgggtaaaaatattcggttgtgcaaaccatccaaacgtcaaccggtgcggtga

SEQ ID NO: 7276 - RNA, 3159 nt, synthetic construct
  misc_feature 1..3159: note = Cas9 variant
  source 1..3159: mol_type = other RNA
atgaaaaacaccagtctaaactatgtcctcgggctcgacctaggcatcagctcagtagggtgggccgttgtcgaaatcgatgaaaaagaaaacccactgtcactaatagacgttggagtacgaacattcgaacgcgccgaaacacaaaaaggagaaagcctcgcccttgcccgccgactcgccaggtcagcacgaagactgacacagcgcagagtggcccggttgaagaaagcaaaaagactcctaaagagcgaaaacatcctcttaagcaccgacgagtgcctcccacaccaggtctggcaacttagggtcgaaggactagaacgaaaactcgaacgccaagaatgggccgcagtactcttacacctgatcaaacacagaggataccttagccaacggaaaaatgaatcaaaatccgagaacaaggaactgggcgcactcctgtccggcgtcgccaataaccacaaactcctccaacaaaccacctaccgtacgcccgccgagctcgcggtcaagaaattcgaagtagaagaaggtcacatcaggaaccaacaagggtcctacacccacaccttcagccgcctggacctcctctccgaaatggaactgctattctcccgccaacaacacttcgggaacccgttcaccagcgagaaactcctagaaaacctaacagccctcctaatgtggcaaaaacccgcgctatccggagacgcaatactcaaaatgctgggcaaatgcacattcgaaaatgaatacaaagccgcaaaacatacatatagcgcagaacggtttatctggatcacaaaactaaacaacctacgcatccaagagaacggactcgaacgagcactcaatgacaacgaacgcctagcgttaatgaaacagccctacgaaaaagcgaaactaacctacgcccaagtccgctccatcctaaacctctccgatgaagcaatcttcaagggactaagatacagcggcgaggacaaaaagaccagcgaaacaaaaacagttctcatggagatgaaggcttaccaccagatacgactcgccctagagaaaaacgatctcaaaactgaatgggcagaactaaaagtgaactcgagtctcctcgacgaaataggaaccgccttctccctctacaaaacagacgaagacatctctacctgcctagcgggaaaactcagccagcccgtactcaacgccctactggaaaacctcaacttcgacaaattcatccagctgtccctcaaggccttacacaaaatcctcccgctgatgcagcaaggcctacgttatgacgaagcatgcgcagagatctacggagaccactatggaaagaagaccgaagaaaaccacctcctcctcccgcagatcccggccgacgaaatcaggaacccagtcgtactccgaacactcacacaagcccggaaggtaataaacggcgtcgtgcggctatactcgagccctgcgcggatacatatagaaaccggccgagaagtcggcaagagctaccaggatcgccgcgaattagaaaagcgccaggaggaaaaccggaaacaacgggagaaagccatatccgagataaagaccctcttcccaaacttctccggagagcccaaagccaaagatatcctgaaaatgagactatactaccaacaaaacgccaagtgcctgtatagcgggaaacccctcgaactacaccgactactcgagcaaggatacgtagaaatagatcacgccctaccattctctcgaacatgggacgacagcttcaacaacaaagtactggtcctggccaacgagaatcagaataaaggcaacctaacaccattcgaatggctagacggtaaaaacaacagcgagagatggaaggcattcaaggccctagtggaaacgagcgcattcccctacacgaagaaacaacgaatactatcacagaaactagacgaaaaaggcttcatagaacggaacctaaacgacacacgctacgtcgcacgcttcctttgtaacttcatcgcggacaacatgcacctcacaggtgaaggcaaacgaaaagtcttcgccagcaacggacagatcacagccctactccgaggcagatggggactggccaaaagtagggaggataacgaccgccatcacgccctcgacgcagtcgtagtagcttgctccaccgtaagcatgcagcagaaaatcacccgattcgtgcgcttcgaagaaggcaacgtattcacaggcgaacgaatagacagagaaaccggtgaaataatcccgctgcactttcctgcaccctggaagttcttccgagaagaagtggagatacggatcttttccgacaaccccaaactcgaactcgagaaccggctgatagcccggcctcaagccaaccatgagttcgtacaaccccttttcgtcagcagaatgcccacgcgaaaaatgacaggccaaggccacatggaaacaatcaagagcgccaaacgactaaacgaaggcctgtcagtcataaaaatgttgctcacgaaactccggctaaaggacctagagtccatggtaaaccgggaacgagaaaaggaactgtacgaggccttaaaagcacgcctagaagcctttaacgacgagccagctaaagccttcgccgaaccgttcatgaagaaaggaggagccatcgtgaaatccgtccgagtcgagcaagtccaaaaatctggagtcctagtacgagacggaaacggcgtagccgacaacgcaagcatggtacgggtcgacgtcttcacgaaagggggcaaatacttcctagtgcccatatacacgtggcaagtcgcaaagggcatactccccaacaaagcagtaatccaaggcaagaacgaagaagactgggaagtcatggacgatgccaccttccgcttcagcctccaccaaaacgacctcgtcaagctagtcaccaaaaagaaaacgatattcggatacttcaacggactaaaccgagcaacaggaaacattgatatcaaagaacacgacctcgagaaaagcaaagtgaaggacggcatacatcagtccatagggatcaagctggccctctctttcgaaaaataccaggtcgacgaactcggcaaaaacatccggctatgcaaaagcagcaaacgccaagcagtacgttga

SEQ ID NO: 7277 - RNA, 3159 nt, synthetic construct
  misc_feature 1..3159: note = Cas9 variant
  source 1..3159: mol_type = other RNA
atgattggcgagcacgtaagaggcggctgcctattcgacgaccactggacacccaattggggagccttcaggctccccaacaccgtccgaacatttacaaaagctgaaaaccccaaagatggctccagcctagccgaaccaagacggcaggcacgcggcctccgccgcaggctccggagaaaaacgcaacgactagaggacctgagacgactcctggcgaaagaaggcgtccttagcctcagcgacctcgaaaccctcttccgagaaacacccgcaaaagatccgtaccaactccgcgctgagggcctagaccgtcccctatctttccccgagtgggtgcgagtcctctaccacatcacaaaacatagaggcttccagtctaatcgacgcaaccccgttgaggacggacaagagcgctcaagacaagaggaagaagggaaactcctctctggagtcggcgaaaacgaacgactactaagggaagggggataccgcaccgccggagagatgctagctcgagacccaaagtttcaagaccaccgccgcaaccgcgccggggactactcccacaccctctcacgcagtttactactcgaagaggcccgacgactattccaaagccaaagaaccctcgggaacccccacgcgagcagcaacttagaagaagcattcctacacctcgtcgcattccaaaatcccttcgccagcggagaagacatcagaaacaaagccggacactgctccctcgaaccggaccagatcagagcaccaagacggtccgcatcagcagaaactttcatgcttctgcaaaagacaggcaaccttaggctcatccaccggcgaacaggggaggaacgcccactcacggataaagaacgagagcaaatccacctactcgcctggaaacaagaaaaagtgacacacaaaaccctaagacggcacctcgaaatacccgaagaatggttattcaccggcctcccctaccacagatcaggcgacaaggcggaagagaagctattcgtacacctcgccggtatccacgaaatacgtaaagcactagacaaaggaccagaccccgccgtatgggacaccctgaggtcaagacgcgacctgctagactccatcgcagacaccctaacattctacaagaacgaggacgaaatcctccccaggttagaatccctcgggctatccccagaaaacgcccgcgccctcgcacccctatcgtttagcggcactgcacatctcagcctgagcgcactaggcaagctactaccccacctggaagagggcaaaagctacacacaagcacgagccgacgcagggtacgccgccccgccaccagaccgacatcccaaactaccgcccctagaagaggcagactggcgtaatccagtagtgttccgcgccctcacccaaacccggaaagtcgtgaacgcccttgtccgccgatacggaccaccctggtgcatacatctcgaaactgccagagaactcagccaacccgccaaagtgcggcgaaggatcgagacagagcaacaagcaaacgaaaagaaaaagcaacaggcagaacgagagttcctagacatagtaggcaccgcccccggaccaggcgacctgctcaaaatgcgactctggagagaacaaggcggcttctgcccctactgcgaagaatacctgaacccaacccgcctagcagaaccaggctacgccgaaatggaccacatcctcccatattccagatcactcgacaacggttggcataacagagtccttgtacacggcaaggacaaccgcgacaaagggaatcggacccccttcgaagcattcggaggcgacaccgcgcgctgggacagattagtcgcatgggtacaggcgtctcacctctcggcccccaagaaacgaaacctacttagagaagatttcggagaggaagcagagcgagaactaaaggacagaaacctgacagacacgagattcataacaaaaactgccgcgaccctactcagggacagactgacattccaccccgaagcaccaaaagacccagtaatgacgctaaacggccgcctcaccgccttcctacgtaaacaatggggtctccacaaaaaccgaaagaacggcgatctacaccacgctctagacgcagcagttctcgctgtcgcgtcacggagctttgtataccgactctcctcgcataacgccgcatggggagaactcccccgaggaagggaggcagaaaacggcttctcactcccctacccagcattccggagcgaagtactagcacgactctgccccacgcgggaagaaatactactacgactggaccaagggggagtaggctacgatgaggcattccgaaatggcctgcgccccgtattcgtatcccgagccccatcacgacggcttcgaggcaaagcacacatggaaaccttacggtcccccaaatggaaggaccacccagagggaccccgcaccgcctccagaatcccactaaaagatctgaacctggaaaaacttgaacgcatggtagggaaggaccgcgaccgaaagctatacgaagccctaagagaacgattagccgccttcggcggcaatgggaaaaaggcattcgtcgctccattccgtaaaccatgtagaagcggagaaggcccactcgtcagaagcctccggatattcgatagcggctacagcggagtcgaactaagagacggcggagaagtctacgcggtcgcagatcacgaaagcatggtgcgagtggacgtctacgcaaagaaaaacagattctacctagtccctgtctacgtcgcagacgtagctcgcggaatcgttaaaaaccgtgcaatagtagcacacaaaagcgaagaagaatgggacctagtagatgggagcttcgacttcagattcagcctattcccaggagacctcgtggaaatcgaaaagaaagatggggcctatctaggatactacaaatcgtgtcaccgcggggatggcagactattactcgacagacacgaccgaatgccccgagaaagcgactgtggtacattctacgtaagcacaagaaaagacgtactgagcatgtccaaatatcaagtagatcccctgggggaaatccgcctagtgggctcagaaaagccgcccttcgtcctatga

SEQ ID NO: 7278 - RNA, 3162 nt, synthetic construct; identical to SEQ ID NO: 1382
  misc_feature 1..3162: note = Cas9 variant
  source 1..3162: mol_type = other RNA

SEQ ID NO: 7279 - RNA, 3162 nt, synthetic construct; identical to SEQ ID NO: 1479
  misc_feature 1..3162: note = Cas9 variant
  source 1..3162: mol_type = other RNA

SEQ ID NO: 7280 - RNA, 3162 nt, synthetic construct
  misc_feature 1..3162: note = Cas9 variant
  source 1..3162: mol_type = other RNA
atgaagcgcaactacatcctgggcctcgacatcggaatcaccagcgtgggctacgggatcatcgactacgagacccgggacgtcatcgacgccggcgtgcgcctgttcaaggaggccaacgtggagaacaacgaggggcggcgctccaagcggggcgcgggccgcctgaagcggcgccggcgccaccggctccagcgcgtcaagaagctgctgttcgactacaacctcctgacggaccactccgagctgtccgggatcaacccctacgaggcccgggtgaagggcctctcgcagaaactgtccgaggaggagttcagcgccgccctgctccacctggccaagcgccgcggggtgcacaacgtcaacgaggtggaggaggacaccgggaacgagttatccaccaaggagcagatcagccggaactccaaggcgctcgaggagaagtacgtggccgagctgcagctggagcggctcaagaccgacggggaggttcgcggcagcattaaccggttcaagacgtccgactacgtgaaggaggccaagcagctgctgaaggtgcagaaggagtaccaccagctcgaccagagcttcatcgacacctacatcgacctactggagacccgcagaacctactacgagggcccgggggagggctcccccttcgggtggaaggacatcaaggagtggtacgagatgctcatgggccactgcacgtacttccccgaggagctgcgcagcgtcaagtacgcctacaacgcggacctgtacaacgccctcaacgacctcaacaacctggtgatcgccagggacgagaacgagaagctcgagtactacgagaagttccagatcatcgagaacgtattcaagcagaaaaagaagcccaccctgaagcagatcgagaaggagatcctggtcaacgaggaggacatcaagggctatcgggtgacctccaccggcaagccggagttcagcaacctcaaggtgtatcacgacatcaaggacatcacggcccgcaaggagatcatcgagaacgccgagctgctggaccagatcgcggaaatcctcaccatctaccagtccagcgaggacatccaggaggagctggtcaagctgaactccgagctcacccaggaggagatcgagcagatcagcaacctgaagggctacaccgggacgcacaacctgagcctcaaggccatcaacctgatcctggacgagctctggcacaccaacgataaccagatggccatcttcaaccggctgaagctggtgcccaagaaggtggacctctcccagcagaaggagatccccaccaccctggtcgacgacttcatcctcagccccgtggtgaagcgctccttcatccagtcaatcaaggtcatcaacgccatcatcaagaagtacggcctgccgaacgacatcatcatcgagctcgcccgggaaaagaactccaaggacgcgcagaagatgatcaacgagatgcagaagcgcaaccggcagacgaacgagcgcatcgaggagatcatccggaccaccgggaaggagaacgccaaatacctgatcgagaagatcaagctgcacgatatgcaggagggcaagtgcctctacagcctggaggccatccccctggaggacttgctgaataaccccttcaattacgaggttgaccacatcatcccccgctccgtcagcttcgacaactccttcaacaacaaagtgctggtgaagcaggaggagaacagcaagaagggcaaccggaccccgttccagtacctctccagctccgacagcaagatctcctacgagacgttcaagaagcacatcctgaacctggccaaggggaagggacgcatcagcaagaccaagaaggagtaccttctggaggagcgggacatcaaccgcttctccgtccagaaggacttcatcaaccggaacctggtggacacccgctacgccacccgggagctcatgaacctgctgcgcagctacttccgggtgaacaacctcgacgtcaaggtgaagtccatcaacgggggcttcacgtccttcctgcgccgcaagtggaagttcaagaaggagcggaacaaagggtacaagcaccacgcggaggacgccctgatcatcgccaacgccgacttcatcttcaaggagtggaagaagctcgacaaggccaagaaggtgatggagaaccagaccgtcgaggagaagcaggcggagagcatgtccgagatcgagacagagcaggagtacaaggaaatcttcatcacgccccaccagatccagcacatcaaggacttcaaggactacaagtacagccaccgcgtagacaagaagcccaaccgggagctgatcaacgacaccctgtacagcacccgcaaagacgacaaaggcaacaccctcatcgtgaacaacctgaacggcctgtaccacaaggacaacgacaagctaaagaagctgatgaacaagagccccgagaagctgctcatgtaccaccacgacccgcagacctaccaaaagctgaagctgatcatggagcaatacggggacgagaagaaccccctttacaagtactacgaagagacgggcaactacctgaccaagtactccaagaaggacaacgggcccgtcatcaagaagatcaagtactacggcaataagctgaacgcccacctcgacatcaccgacgactaccccaacagccggaacaaggtggtgaagctgtccctgaagccgtaccgctttgacgtctatctcgacaacggtgtgtacaagttcgtgaccgtcaagaacctgaacgtaatcaagaaggagaactactatgaggtgaactcaaagtgctacgagaaggccaagaagctgaagaagatctccgaccaggccgagttcatcgcgagcttctacaacaatgacctcatcaagatcgacggggagctgtaccgggtcatcggcgtgaacaccgacctgatcaaccgcatcgaggtaaacatggtcgacatcacgtatcgggagtacctcgagaacatgaacgataagcgaagcccccggatcttcaagaccatcgcctccaagacccagagtatcaagaagtacagcaccgacatcctggggacgctgtacgaggtgaactccaagaagcacccccagatgatcatgaagggctga

SEQ ID NO: 7281 - RNA, 3162 nt, synthetic construct
  misc_feature 1..3162: note = Cas9 variant
  source 1..3162: mol_type = other RNA
atgagtggcatggtgttcgggatagacctaggcatagccagctgcgggtgggccgtactcaggcaaccgcaaagagacggcgatccaggagagatagtagacctgggcagttggatgttcgatgtgccggaaacagacaaagaaaggacgccaacaaaccaggtcagaagggggaacagactcctcagacgcgtaatcagaaggagagcacaaagaatggtggaaataaggcgcttattccacgaccatgggttgctggcaggccacgctccagaagcactaaagagagcagggctggatccgtgggatcttagggcaaggagcctagacaaggtattggaaccagcggcactggcagtagcactgggccacatagcaaaaagacgcggcttcaagagcgccgcgagaaggaaagaagctaacacggcaggggacgaccagaaaatgttaaaagcattggaagcgactcacgagaggctggggcgatacaggacgataggagagatgttcgcacgcgatccagactttgaaagcagaaagaggaatagagatggcatgttcgacagaacacagggcagagacgacctactgcatgaggtgggcgaaatattcaaagcacagagaagactaggaagtgcgctggcaacggcagagctagaacaagccttcacggcaatcgcattcaggcaactaccaatacaagacagtgaaaggctagtcggactgtgccaatttgaaccaaaggagaagagagccgcgcggttcgcgcccagcttcgagcgattcagattacttcaaaggctcacgaacctcagagtggtaacggttgagggtgaacgaccactaacagccgacgaaatagcagcggcagcggccgacctgggcagaacggcaaaactctcggtaaaggaggtaaggaaacgcataggtctagcagcagaccaccgcttcgccgcattcaaagccgatgaagaggacagggacataatcgcgcggacaggagaggcgctgcacgggacgtaccgactacgcaaggcactaggcgaaggactatgggccgaaatgttaccaggccagttggacgcaatagcacacgcgctgagcttcttcgagacccaggacgttatactgaaagaactcgataaactagacctaccggccggagtaagagacgcaatagcaacaggattagacgcgggggcattcgcaagattcaagggaacgggccacataagcgcgagagccgccagggcgttgcttccgcacctcgaagccggattgagatacgaccaagcgtgtacaaaagcagggtatgaccacgcggcatcgaggtgggcaaaaagggagcaagtagcggacaaagccgcattcaaccgcctagtaacggacatgggggccgagatcgccaatccgatcgcacggaagagtcttactgaagctctgaagcaactatgggccatgaggaacaggtggggtctgccggacgccatacacatagagctcgcgcgcgacgtgggcaatagcctggagaaaagaagggaaattgaaagggcgatagaaaagaacaccgcggcgagagaacgcgaaagaggagaagcaagggacctgctcggaatagacgacgtaagcggggacacacttctacgatacaggctgtggaaagaacaggcagggagatgtccctacacagacgcaccgataccgcccggagcgatcatcgcgaccgataactcattccaggtagaccacatcttaccctggagcaggttcggggacgacagcttcgccaacaaagtactatgcgcaacggcagcaaatcaaagaaagaaagggcagacaccctgcgaatggataacagcggcccagggagaggaaggatgggcaacattcgtcgccaggatagaaggaaacgccgcgttccgaggcccgaagaaacgaaactacgtacttaaaaacgcaaaagaagccgaagagaggttccgagccagaaacctgaacgacacaagatacgcagcgagactgctagcagaagcagtgaaactattctaccctgaaggagaaagacaggacaaaggaggagtgagacgagtgttcacacgaccgggcggcctgactgcggcactcaggcacgcgtggggagtagaagcgctgaagaaaagagacggcaaacgggtggacgacgcacgccatcacgccctagacgccctagtcgtagcggcaataggcgaaggggaagtacagagactaacgaggagctaccaagaatgggaacagcaagggctcgcaagaccgctacgaagggtcgatcccccgtggggagacttccattccttcaggagagaggtaaaggacgcgtacgacggcatattcgtagcaagaccggaaaggcgacgagcaagaggggagggacacgccgccacgataaggcaagtaagagagcgggacggcgctgctgtagtcttcgaacggaaagcaatcgcggacctaagcgaaaagcggctagcagacatcaaagatccagaacgaaaccaggcgattgtagaggcaatcaggcaatggatagtagacggccgacccgccgaccgactacccaggagcccggcgggagacgagattaggaaagtcagattacgaacaaaaggcaaaccggcagtacaggtgcgaggaggggcagcagaccgaggggaaatcgtgagagtagatgtgtttacaaaaccgaacaagaaagggaaaaacgagttttacctagtaccaatctacccgcaccaagtaatgaacaaggcggagtggccaaccccacccatgagagcagtggtagcttacaaggacgaatccgaatggaccctactagatgaaaacttcggattcctgttcagcctcttcccacggtcgtacgtcgaggtcacaaagccgggaggcgaggtattgagcggctacttccaagggatggacagaagcacgggagcaatcagcctatttaaccaccgtgacagccgatcgctaacagatgacagcgggaatagcacccggggaataggagcgaaaaccctactgacaatgaagaagtacagcgtcgacaggtttggaaagagggcagaggtcaagagtgaagtaagaacatggcacggggtggcctgcacatacccaacgcccccggggtga

SEQ ID NO: 7282 - RNA, 3165 nt, synthetic construct
  misc_feature 1..3165: note = Cas9 variant
  source 1..3165: mol_type = other RNA
atgaaactaacacccctgaactacatcctaggcctagacctcggcatagcctccgtcggctgggcggtcgtcgaaatcgatgaacaagaaaaccccctaggattaatagatgtcggtgtacgcaccttcgaccgcgcagaggtcgcaaagaccggcgagagcctggcgctagccaggcgactcgccaggagctcccgccgactcgtaaaaagacgagcagaccgcatcaagaaagtaaaaagactactgaaatccgaaaacatcctactatccgcagacgaacaacttcccaacgacgtctggcaacttagagtaaaaggactagaccaaaaattagaaagacaagagtgggccgccgtcctgctccacctcctcaagcaccggggatatttatcccaaagaaagaacgagtccaagtctgaaaacaaggaactaggggcccttagaagcggagtggccgcaaatcaccaaatactacaatccgccgagtacagaaccccggcggaaatcgccgtaaagaaatttcacgtcgaagaagggcacatccggaatcaacggggcgcctacacacacaccttcagccgcctagacctcctagcggaaatagaactactatttacgcgacagaccgaacttggcaaccctcacacaagcgccaaattactagaaaacctgaccgcactactaatgtggcaaaagccagcactcgctggcgaagcaatcctcaaaatgctgggcaaatgcaccttcgaacctaccgagtacaaagccgccaagaactcctactccgcagaacgcttcgtctggctaaccaaacttaacaacctacgcatcctagaacaaggcgcagaaagggcgctaacagacaacgaaagattcgctctactagaccaaccttacgaaaaagcaaaattcacctacgcccaagcacgaacaatgctcgccctacccgacgaagccatcttcaaaggcgtccgctaccaaggagaagacaagaaagctgtagaaacaaaaaccatcctcatggaaatgaaagcctaccaccagataaggaaagccctcgagaacgcggacctaaaagccgaatggaacgaactcaaaaacaacagcgaactactagacgacataggaacagccttctccctacacaaaactgacgaggacatctgccgctacttggacggcaaactatcagaatcaatactcaacgcactactcgaaaacttaaatttcgacaaattcatccagctctccctaaaagcactacagcaaatactcccgcttatgctccaagggcagcgatatgacgaagcagtaagcgcaatctacggcgatcattacggaaagaaaagcgccgaaatcaaccgcctactccccaccatacccgcagacgagatccgtaacccggtagtactgcggacattaacccaagcccgtaaagtgattaacgcggtggtaaggctatacggctccccagcccgcatccacatcgaaacaggaagagaagtcggcaaatcctaccaagacagaaagaaactggagaaacaacaagaggacaaccgtaaacaccgcgaaagcgcggtccaaaaattcaaagaatactttcccaactttgtaggtgaaccaaagggcaaagacatcctcaaaatgaggctctacgaactccaacaggcaaagtgcctctactccggaaaaagcctagaactccaccggcttctagagaaaggatacgtagaagtagaccacgctctaccattctcgcggacctgggacgactccttcaacaacaaagtactggtcctcgctaacgaaaaccaaaacaaagggaacctaactccatatgagtggctggacgggaaaaacaattcagaaccatggcagaacttcgtagcacgagtacaaacatctggcttcagccacacaaagaaacagcgcatcctttctcacaagctagacgaaaaaggcttcatcgaaaggaacttaaacgacacacgctacgtggtacgattcctgtgcaatttcatcgcagataacatgctcctaaccggtaaaggaaaacgcaaagtcttcgccagcaacggacagataacagccctcctacgaggccgctggggcctccaaaaggtgcgcgacgacaacgaccgacatcacgcactagacgccgtcgtcgtcgcctgcagtaccgtagctatgcaacagaaaatcacccgcttcgtacgctatgaagaaggaaacgtattctcaggggagcgcatcgatcgcgaaactggcgaaataatccctctccacttcccgtcgccatgggcattctttcgcgaaaacgtagaaatccgaatcttctcagaaaaccccaaactcgaactagaaaaccggctaccagactacccgcaatacaaccacgagttcgtccagccactgttcgtctcgcgtatgccaacccgaaaaatgaccggccaaggacacatggaaacagtcaaaagcgccaagagactcgacgaaggactctccgtcctcaaagtgcccctgactcagctcaaactgaacgacctcgaacgcatggtcaaccgcgaacgcgaaatggccctctacgaaagtctaaaggtaagactcgagcaattcgacaacgaccccgcaaaagccttcgcagaacccttttataagaaaggcggcgcactggtgaaagccgtccgcgtcgaacaaacccagaaaagcggcgtcctcgtccgagatggaaacggagtagccgacaacgccagcatggttcgagtcgacgtcttcaccaaagccggcaaatactttctcgtcccaatatacacctggcaagttgcaaaagggatactccccaataaagctgtaacggccaatgttgacgaaatagactggcttgaaatggatgaaagctaccaattcatattcactatgtatccaaacgacttagtaaaagtcaaactgaaaaaggaagagttcttcggctactacggagggctagaccgcgcaactggcgccatagtcatcaaagaacacgacctcgaaaaatccaagggccgccaagggatataccgcattggagtgaaactcgccctctcattcgaaaagtaccaagtagacgaactagggaaaaacataaggccctgccgaccaacaaagcgacaacacgtacgatga

SEQ ID NO: 7283 - RNA, 3165 nt, synthetic construct; identical to SEQ ID NO: 1483
  misc_feature 1..3165: note = Cas9 variant
  source 1..3165: mol_type = other RNA

SEQ ID NO: 7284 - RNA, 3165 nt, synthetic construct
  misc_feature 1..3165: note = Cas9 variant
  source 1..3165: mol_type = other RNA
atgaaccagaagttcatcctgggcctcgacatcgggatcaccagcgtgggctacgggctgatcgactacgaaaccaagaacatcatcgacgccggcgtccgcctgttccccgaggccaacgttgagaacaacgaggggcggcgctccaagcggggcagccgccggctcaagcgccggcgcatccaccggctggagcgcgtgaagaagctgctcgaggactacaacctgctggaccagtcccagatcccgcagtcgacgaacccctacgcgatccgggtcaagggcctctccgaggccctgagcaaggacgagctggtgatcgccttactgcacatcgccaagcgccgggggatccacaagattgacgtgatagactccaacgatgacgtcggcaacgagctgagcaccaaggagcagctaaacaagaactccaagctgctgaaggacaagttcgtgtgccagatccagctcgagcgcatgaacgaggggcaggtcagaggcgagaagaaccgcttcaagaccgccgacatcatcaaggaaatcatccagttgctgaacgtgcagaagaacttccaccagctcgacgagaacttcatcaacaagtacatcgagctggtggagatgcggcgcgagtacttcgagggacccggcaagggcagcccctacgggtgggagggcgacccgaaggcgtggtacgagaccctgatggggcactgcacgtatttccccgacgagctccggtccgtgaagtacgcttacagcgccgacctgttcaacgccctgaacgacctcaacaacctcgtcatccagcgcgacggcctgtccaagctcgagtaccacgagaagtaccacatcatcgagaacgtgttcaagcagaagaagaaacccaccctgaagcagatcgctaacgagatcaacgtgaaccccgaggacatcaagggctatcggatcaccaagagcgggaagccgcagttcaccgagttcaagctgtaccacgacctcaagagcgtcctgttcgaccagagcatcctggagaacgaggacgtactcgatcaaatcgccgaaatcctgacgatctaccaggacaaggactccataaagagcaagctgaccgagctcgacatcctgctgaacgaggaggacaaggagaacatcgcccagctcaccggctacaccgggacgcaccgcctgtccctgaagtgcatccgcctcgtgctggaggaacagtggtacagcagccggaaccagatggagatcttcacccacctgaacatcaagcccaaaaagatcaacctcaccgccgccaacaagatccccaaggcgatgatcgacgagttcatcctgtcccccgtcgtgaagcgcaccttcggccaggccatcaacctgatcaacaagatcattgagaagtacggggtgccggaggacatcatcatcgagctggcccgggagaacaacagcaaggacaagcagaagttcatcaacgagatgcagaagaagaacgagaacacgcgcaagcggatcaacgagataatcggcaagtacggcaaccagaacgccaagcgcctcgtcgagaagatccggctgcacgacgagcaggaggggaagtgcctgtactccctcgagagcatccccctggaggacctgctcaacaaccccaaccactacgaggttgaccacatcatcccccgctccgtgagcttcgacaactcctaccacaacaaggtcctggtgaagcagagcgagaactccaagaagtccaacctgaccccctaccagtacttcaatagcggcaagagcaagctctcctacaaccagttcaagcagcacatcctgaacctgagcaagtcccaggaccggatcagcaagaagaagaaggagtacctcctggaggaacgcgacatcaacaagtttgaggtccagaaggagttcatcaaccggaacctggtggacacccgctacgccacccgggagctcacgaactacctgaaggcgtacttctccgccaacaacatgaacgtgaaggtcaagaccatcaacgggagcttcaccgactacctgcgcaaggtgtggaagttcaagaaggagcggaaccacggctacaagcaccacgccgaggacgccctcatcatcgccaacgcggacttcctgttcaaggagaacaagaagctgaaggccgtgaactccgtcctcgagaagcccgaaatcgagagcaagcagctggacatccaggtggacagcgaggacaattacagcgagatgttcatcatccccaagcaggtccaggacatcaaagacttccgcaacttcaagtacagccaccgggtggacaagaagcccaaccgccagctgatcaacgacaccctctactccacgcggaagaaggataacagcacctacatcgtgcagaccatcaaggacatctacgccaaggacaacaccacgctgaagaagcaattcgacaagtccccggagaagttcctgatgtaccagcacgacccccgcaccttcgagaagctcgaggtgatcatgaagcagtacgccaacgagaagaaccccctggccaagtaccacgaggagaccggggagtaccttaccaagtacagcaagaagaacaacggccccatcgtcaagtccctcaagtacatcggcaacaagctggggagccacctggatgtcacgcaccagttcaagtccagcaccaagaagctcgtcaagctgtccattaaaccgtaccggttcgacgtctacctgaccgacaaaggctacaagttcatcaccatcagctacctcgacgtgctgaagaaagacaactactactacatccccgagcagaagtacgacaagctgaagctcgggaaggcgatcgacaagaacgccaaattcatcgcctccttctacaagaacgacctgatcaaactggacggcgagatctacaagatcatcggggtgaacagcgacacgcggaacatgatcgagctagacctgcccgacatccgctacaaggagtactgcgagctgaacaacatcaagggcgagccccggatcaagaaaaccatcggcaagaaggtcaactccatcgagaagctcactaccgacgtgctggggaacgtgttcaccaacacgcaatacaccaagccgcagctcctgttcaagcgcggcaactga

SEQ ID NO: 7285 - RNA, 3165 nt, synthetic construct
  misc_feature 1..3165: note = Cas9 variant
  source 1..3165: mol_type = other RNA
atgaagttaacacccctcaactatatactaggcctagatctgggaatagccagtgtcgggtgggcagttgtagagatagacgaacaggaaaaccccctcggcctaatcgacgtcggagtacgcacgttcgacagagccgaggtacccaagaccggcgaatccttagccctcgcacgtcgactcgcccgctccgcccgccgcctggtgaagcggagggccgacagaatcaaaaaggccaaacgtctcctaaaagccgaaaacatactcctatcggcagacgaacacctacccaacgacgtctggcaactcagagtaaagggcctagaccaaaaactcgaacgacaagaatgggccgcagtcctcttacatctgctaaaacaccgaggctacctttcgcaacgcaaaaacgaatccaaatcagaaaacaaagaacttggagcactgctaagcggtgtggaaactaaccaccagatcctccaatccgccgaataccgaacacccgccgaaatcgccgtcaagaaattccacgtcgaagacggacacataaggaaccagcgcggcgcctacacccacaccttctcacggttagacctcctcgccgaaatggaactgctattccaaagacagaccgacctcggcaacccccacacaagcgcaaagctactcgaaaacctcacagcgctcctcatgtggcaaaaaccggcactggccggcgaagccatactaaaaatgctcggaaaatgcaccttcgagcccaccgaatacaaggcagcgaagaacagctacagcgcagaacgattcgtctggctaaccaaactcaacaacctccgaatcctggaacagggagcagaacgcgcgcttacagacaacgaacggtttgccctcctggaccaaccgtacgaaaaagccaaattcacctacgcacaagcccgcaccatgctagccctccccgacgaggccatattcaaaggggtacgataccaaggcgaggacaagaaagccgtcgaaacgaaaacaatcctaatggaaatgaaagcataccaccaaattcgtaaagcactcgaaaacgcggacctaaaagcagaatggaatgagctcaaaaacaactctgaactactagacgacatagggacagccttctcactacacaaaaccgacgaagacatctgccgatacctggacggaaaactatcagagtctattctgaatgcactccttgagaacctaaacttcgataaattcatacagcttagcctcaaagccctccaacaaatattgcccctaatgctccaaggtcaacgatatgacgaagcagtctccgccatctatggcgaccactacggcaaaaagtcggcggagatcaaccggctactgccaacgatccccgcagacgaaatccgtaatccggtcgtactacggacactcacacaggcacgaaaggtgatcaatgcggtcgtccgactctacggctccccggcccgaatacacatcgaaacaggcagagaagtcggcaaatcttaccaagaccgcaagaaactcgagaaacaacaggaagataaccgcaaacaacgcgaatccgccgtcaagaaattcaaagaatactttccgaacttcgtaggggaaccaaaagggaaagacatactaaagatgcggctctacgagctacaacaggcaaaatgtctctactccggcaaatcactagaactacaccgactgcttgaaaaaggctacgtcgaagtagaccatgccttaccattctcccgaacatgggacgactcattcaacaacaaagtcctagtcctggccaatgagaaccaaaacaaaggaaacctcacgccatatgaatggctggacggcaaaaacaacagcgaacactggcaaaacttcgtcgctagagtccaaacttccggcttctcacacaccaagaaacaaagaatactctcccacaagctcgacgagaaagggttcatcgagcgcaacctaaacgacacccgctacgtcgcacggttcctatgtaacttcattgcagacaacatgctcttaaccggcaagggcaaacgcaaggtcttcgcctcaaacggccaaatcaccgcacttctacgagggcgctggggcctccaaaaagtacgcgacgacaacgaccgacaccacgcactagacgctgtagtcgtcgcgtgctcaaccgtcgtaatgcaacaaaagataacgagattcgtaagatacgaggaaggcaacgtattcagcggcgaaagaatcgaccgagagacaggcgagataatcccccttcacttcccatcaccgtgggcgttctttcgggaaaacgtcgaaatacgtatattctccgagaaccccaagctggaactcgaaaaccgactaccagattacccccagtataaccacgagttcgtacaaccccttttcgtatcacgaatgccaacccggaaaatgactggccaaggccacatggaaaccgtaaaaagcgccaaacgcctcgatgaaggactcagcgtgctcaaggtaccactaacgcaactcaagctgtcagaccttgagagaatggtaaaccgcgaacgtgaagtcaccctctacgagtcactcaaagcccgactagaacaattcggcaacgacccagccaaagcgtttgctgaaccgttccacaagaaaggtggcgccgtggtcaaagcagtcagagtcgagcaaacacagaaaagtggggtcttagtacgcgacggcaacggcgtagcagataacgcctccatggtccgagtagatgtattcacaaagggcggaaaatactttcttgtcccgatatacacctggcaagtggcgaaaggcatcctccccaacaaggcggttacggccaacgtcgacgaaatcgactggctcgagatggacgaatcataccaattcatcttcaccatgtaccctaacgacctggttaaggtgaagctcaagaaagaagagttcttcggctactacggagggctagacagggccaccggggctattgtaatcaaagaacacgacctggagaaaagcaaagggaaacagggtatttacagaataggagtaaaactagccctatccttcgaaaaataccaagtagacgaactcggtaagaacatccgcccctgccggccaacaaaacgacaacacgtccgctga

SEQ ID NO: 7286 - RNA, 3165 nt, synthetic construct; identical to SEQ ID NO: 1486
  misc_feature 1..3165: note = Cas9 variant
  source 1..3165: mol_type = other RNA

SEQ ID NO: 7287 - RNA, 3165 nt, synthetic construct
  misc_feature 1..3165: note = Cas9 variant
  source 1..3165: mol_type = other RNA
atggaaaacaagaacctcaattacatccttggcctcgacctcggcatagcaagcgtaggctgggccgtagtagaaatcgacgagaaggagaaccccctaagactaatcgacgtgggcgtccgaacattcgaacgagccgaagttccgaaaactggcgagagccttgcgctgtcccgacgactagcaagaagcgcgagaaggctcacacaacgacgcgtcgcacgcctaaagaaagccaagcgtctcctaaagtccgaaaacatactgctatcaaccgatgaaagactgccccaccaggtctggcaactacgagtcgaaggactcgatcacaaactcgaacgacaagaatgggccgctgtcctactccaccttattaaacaccgaggatacctctcccagcgcaaaaacgagagcaagagcgagaacaaagaactaggcgcactcctaagcggagtagacaacaatcacaaattactacaacaagcaacctaccgaagccctgccgagctcgcagtaaagaaattcgaagtggaagaaggccatatccgaaaccagcagggggcgtacacccacaccttcagccgactcgacctactggcagaaatggaacttctcttctcacgtcaacagcacttcgggaacccattcgcaagtgagaaactactcgaaaacctgacagccctcttaatgtggcaaaaacctgccctctccggcgaagcgatcctaaaaatgctaggcaaatgcaccttcgaagacgagtacaaagccgcaaagaacacatacagcgcagaacgcttcgtgtggataacaaaactcaataacttgagaatccaagaaaacggactcgaacgcgcgctcaacgacaacgaacgccttgcacttatggagcaaccatacgacaaaaaccgcctattctattcccaggtccgaagcatcctgaaactatcggatgaagcaatcttcaaagggctcaggtactctggggaggacaagaaagccatagagacaaaagcagtactaatggaaatgaaggcttaccaccaaatacgcaaagtactagaaggaaacaacctcaaagccgaatgggccgagcttaaagcaaacccaaccctgctcgacgaaattggcaccgccttcagcctatacaaaaccgacgaagacatatccgcatacctcgctgggaaactttcccagccagtcctcaacgcgctactagagaacctcagcttcgacaaattcatacagttatccctgaaggccctctataagctgctaccactcatgcaacaaggactccggtacgatgaagcctgccgcgaaatctacggagaccattacggcaagaaaaccgaggagaaccaccacttcctcccacagatcccggcagacgaaatcagaaacccagtagtattgcggacgttaacccaagcacgtaaagtgatcaacggggtagtgcgcctgtacggctccccagctcgcatccacatagagacaggccgtgaggttggaaaaagctacaaagacagacgagaactcgaaaagcgtcaagaagaaaaccggaagcaacgggaaaatgccattaaggagttcaaagaatattttccccacttcgccggcgaacctaaagcaaaggacatactcaaaatgcgcttatacaaacaacagaacgcaaaatgcctatacagcggaaagcccatcgaactccatagattgctcgagaagggatacgtcgaagtggaccacgccctcccctttagccggacctgggacgacagcttcaacaacaaagtactcgtactcgcaaacgaaaaccaaaacaaagggaatctcacacctttcgagtggctagacggaaaacacaatagcgagaggtggcgagcattcaaagccctagtcgaaacgagcgcattcccctacgcaaagaaacaacgcattctcagtcagaaacttgacgaaaaaggcttcattgaacgaaacctaaacgacacccggtacgtcgctcgctttctctgcaacttcatagcagacaatatgcacctcacaggcgagggcaaacgaaaagtattcgcatcgaacggccaaataaccgctctcctcagaagccgatggggcctggccaagtcacgagaagacaacgaccgacaccacgcgctcgacgccgtcgtcgtcgcctgcagcaccgtagcgatgcaacagaaaattacgcgcttcgtgcgattcgaagccggggacgtattcacaggagaacgaatagaccgcgaaaccggagagatcataccactccacttccccacaccctggcaattcttcaaacaagaagtcgaaatacgcatcttctccgacaaccccaaactagaactcgagaaccgactaccagacagaccacaagccaaccacgaatttgtacaaccactcttcgtctccagaatgccgacccgaaaaatgaccggccaaggacacatggagactgtcaaaagcgcaaaacgcctcaacgaaggaatcagcgtaattaaaatgccgctcaccaagctgaaactcaaagacctcgaactgatggtaaaccgcgaaagagaaaaagacctctacgacacactgaaagcaagactcgaagcgtttaatgacgacccagcgaaagccttcgcagaaccgtttataaagaaaggtggggctatagtcaaaagcgtccgcgtcgaacaaatccaaaagtcaggagtactcgtacgcgaggggaacggcgtcgccgacaacgccagcatggtccgagtcgacgttttcacaaaaggaggcaagtacttcctagttcccatctacacctggcaagtagcaaaaggaatactgcccaacaaggccgcaacccagtacaaagacgaagaagactgggaggtcatggacaactccgccacctttaaattcagcctccacccaaacgatctcgtaaagctcgtgacgaaaaagaaaaccatactcggctacttcaacggactcaatcgcgcaaccggaaacatagatataaaagaacacgacctcgacaaatccaaaggaaaacaaggcatattcgaaggagtaggtatcaaactagcactgagcttcgagaaataccaagtagacgaactaggaaagaacatcagactatgcaaaccatcaaagcgacaacccgtacggtga

SEQ ID NO: 7288 - RNA, 3168 nt, synthetic construct
  misc_feature 1..3168: note = Cas9 variant
  source 1..3168: mol_type = other RNA
atgaacaactacatcctgggcctagacatcgggatcaccagcgtgggctacggtatcgtcgactccgacacccgcgagatcaaggacgccggcgtgcggctgtttcccgaggccaacgtagacaacaacgagggcaggcggtctaagcgcggcgcccggcgcctgaagcggcgccggatccaccgcctcgaccgggtcaagcatctcctggccgagtataacctgctggacttaacgaacatcccgaagtccaccaacccctaccagatccgcgtgaagggcctcaacgagaagctgtcaaaggacgagctggtgatcgccctcctgcacatcgcgaagcggcgcgggatccacaacgttaacgtgatgatggacgacaacgactccggcaacgagctgagcaccaaggaccagctcaagaagaacgccaaggcgctgtccgacaagtacgtgtgcgagctgcagctcgagaggttcgagcaggactacaaggtccgcggagagaagaaccgattcaagaccgaggactttgtccgcgaggcccggaagctgctggagacacagagcaagttcttcgagatcgaccagaccttcatcatgcgctacatcgacctcgtggagaccagacgcgagtacttcgaaggccccgggaagggctcgcctttcggctgggaggggaacatcaagaagtggttcgaacagatgatgggccactgcacctacttcccggaggagctgcgcagcgtcaagtacgcctactccgccgagctgttcaacgcgctcaacgacctgaacaaccttgtgatcacgcgggacgaggaggccaagctcaactatggggagaaattccagatcatagagaacgtgttcaaacagaagaagacccccaacctgaaacagatcgccaaggagatcggcgtcagcgagaccgacatcaagggctaccgcgtgaacaagtccgggaagcccgagttcacccagttcaagctgtaccacgacctcaagaacatcttcgaggacagcaagtacctgaacgacgtgcagctgatggacaacatcgccgagatcatcacgatctaccaggaccccgagtccatcatcaaggagctcaacctgctgccggagctcctgagcgagaaggagaaagagaagatctccgccctgagcggatacgcggggacccacagactctccctgaagtgcatcaacctgctcctggacgacctgtgggaaagctctctcaaccagatggagctgttcaccaagctgaacctcaagcccaagaagatcgacctgtcccagcagcacaagatccccatcaaattagtcgacgacttcatcctaagccccgtggtgaagcgcgccttcatccagtccattcaagtcgtgaacgccatcatcgacaagtacggcctcccggaggacatcatcatcgagctggctcgggagaacaactcagacgaccgccggaagttcctgaaccagctccagaagcagaacgcagagacccgcaagcaggtcgagaaggtgctgcgggagtacgggaatgacaacgcgaaacgcatcgttcagaagatcaagctgcacaacatgcaggagggcaagtgcctctactcgctgaaggacatccccctcgaggacctcctgaagaaccccaaccactatgaggtcgaccacataatcccccgaagcgtggccttcgacaactccatgcataacaaggtgctggtccgcgccgaggagaacagcaagaagggcaaccggacgccgtaccagtacctcaactccagcgagtccagcctgagctataacgagtttaagcagcacatcctgaatctcagcaagaccaaggaccgcatcaccaagaagaaacgggagtacctgctggaggagcgcgacatcaacaagtacgacgtgcagaaggagttcatcaaccggaacctcgtggacacccgctacgccacgagagaactgacctccctgctcaaggcctacttcagcgcgaacaacctggacgtcaaggtgaagaccatcaacgggtccttcaccaactacctgcgcaaggtgtggaagttcgacaaggaccgcaacaagggctacaagcaccacgccgaggacgccctcatcatcgccaacgccgacttcctgttcaagcacaacaagaaactgcggaatatcaacaaggtcctcgacgcgcccagcaaggagatcgacaagaagcgcgtgacggtgcagtccgaagacgagtacaaccagatgttcgaggacacccagaaggcccaggccatcaagaagttcgagatccggaagttcagccaccgcgtcgacaagaagcccaatcggcagctgatcaaggacaccctgtacagcaccagaaacatcgacggcatcgagtacgtggtggagtccataaaggacatctacagcgtcaacaacgacaaggtgaagacgaagttcaagaaggacccccaccggctcctgatgtaccgcaacgacccgcagaccttcgagaagttcgagaaggtgttcaagcagtacgagtccgagaagaacccctttgccaagtactatgaggagaccggcgagaagatccggaagttcagcaagaccgggcaaggcccctacatcaacaagatcaagtacctgcgcgagcggcttggccgccactgcgacgtcacgaacaagtacatcaactcccgcaacaagatcgtgcagctgaagatctacagctaccgcttcgacatctaccagtacgggaacaactacaagatgatcactatatcctacatcgacctggagcagaagtccaactactactacatcagccgggagaagtacgagcagaagaagaaggacaagcagatcgacgacagctataagttcatcggctccttctacaagaacgacatcatcaactacaacggggagatgtaccgcgtgatcggcgtcaacgacagcgaaaagaacaagatccagctagacatgatcgacatctccatcaaggactacatggagctgaacaacatcaagaagaccggggtgatctacaagaccatcggcaagagcacgacccacattgaaaagtacaccaccgacatcctgggcaacctctacaaggcggcgcccccgaagaagccccagctgatcttcaagcgggggatggagtga

SEQ ID NO: 7289 - RNA, 3168 nt, synthetic construct
  misc_feature 1..3168: note = Cas9 variant
  source 1..3168: mol_type = other RNA
atgacacctataagtgagtccctgctattcggactcgacgtcggtataagcagctgcggatgggcggtcctgaaacacagcgacaccactggacacattgaagcactaggaagctggtgcttcaacgcacccgaaaccaagaccgagcgcacccccacaaaccaaatccgtaggagcagtagactactacggagggtggtcagacggagacgaaacagaatgaccgagatacgccgactattcgccagacacggactaatagacaacgaccggcctgacgccctgcggcagcccgccatagacccctgggaaatgagaggccaggggctcgaccgacaactaacaccggaggagttcgccgttgcccttgcgcatatagccaaacaccgcgggttcaagagctctgccaaacgtgtgaaaagcaacgccagtcctgacgattcgaaaatgttggcggccctcgaaaagacaaaagaactatccgcgcaatatcgcaccatcggcgagatgttcgcccgagacagcgcgtacgtacaacgcagacgcaacagagacggcctgttcgaccgaacgattagcagagacgatctgatagacgaggccaaaatccttttcgaccgccaacgcaaactgggcaaccccgtcgcaagcacagagatcgaagaagcattcacacgaatcgccttctggcaaaacccaatgcaagacagcggagtcctagtagcgtcatgcccctttgaacccaaggaaaaacgcagctcacggttttccccgtcgttcgaacgctttcgcctgctctgcaggctgatcaacctgcgagtcaccgacggacccgaggaacgcccactcacagaagaagaactgcgactcgcatacgagcacgccgggaaaacaagaaaattgaccgcagcagcaatacgaaaactcatagggctccgcgacgaccaacacttcacaaccatcccgccagaacaggaaaaacaggacataaccagccgcaccggcgaaaccttcgccggtactgcaacattcaggagcgtattaggagaatctctctggcgccaactcctcccgcaccccgaatggctcgacaacgcagcgtggatcatatcgttccacgagctaacggaaaccatcatcaagaaactaggagaaatcggtctccccgtagaggcatacgaattaatctgcgacgcgctcaaatcagacaaatcaccattcgccaaattcaaaggggccagctccctatccgacaaagctgttcgagcactaatcccgtacctacagcaaggcctgacatacgacaaagcatgccaaaaggccggatacgatcacgccgcaagcaggttcagcgggcgggcaaccatcgacacaaaggcaaagttcaacgcactgatggcggaagtacgagacagcatcgccaatccaatagcacgaaaagccctcagcgaaggaatgaaacaactatgggccatgagaaaccgctggggactccccggcgcgatatgtatcgaactagcccgcgacgtaggcaactccctcgaaaaacgaaaagagatagaacggaacctaaaaacaaccgccaagcaaagagcccgggagcgcgaagaagcatgcgagctccttaacctcaaagaagtaagcagcgacatactcttgcgctaccgcctatggaaagaacagggcggccgatgttgctacagcggaaaaagtatcacacccgacatgctaatggcacaagacaaccgaatacagatcgaccacattctgccatggtcaaggttcggcgacgactcatactcaaacaaaggcctctgcttggccaaggaaaaccaagctaagaaaaaccaaacgccgtacgaatggatccacggccagggtacaaccgcccaaaaagaacaatgggacaagttcgtagccgacgtcgaatcacggaaaaatacaaagggcctgaagaaaagaaactttctactcaaaggatccaaagagatagaggaacgcttcagaagccgaaacctaaacgacacacgatacgcagcacggctcatggtagaagccgctagactactctacccagcagggcaaagaggcgaaaaaggcggcaccagaagagtgttcacgcgcccaggagcactcactgccgcgctccgacacgcatggggagtcgaaagtctcaagaaaatcgacggcgagagactacacgataatcgacaccatgcacttgacgccgccatcgtggctgcagttagcgaggcggagatacaaaaactaacaaaatcattccaagaatgcgagcagaaaggactatcacgcccaatgagagacgtcgccccaccgtgggacggattcagagaccaactcaaagagaaatacgaaacaatcttcgtagcacgcccggaacgccagcgggcacgaggacagggccacgaggccacaatacgccaagtcagagaggaagaaaccggaccagtcatatacgaacgaaaagcagtaagcgccctaacactcgcggaccttgcgaaaatcaaagaccccgacagaaacgcaggcttaatagcgagtcttcgccaatggattgaagccggcaaaccagccgacaagccgcccagaacaccatgccaccaaagcgcagcaggacacgagatccgcaaagtccgattggccacaatcatcacaccggcagtccccgtcagaggaggcatggcaaaaagaggagaaatgacacgagtcgacatattcaaagtaatcggaaagaaaggaaagccagaatggtacatgatcccaatctacccccaccaaatcatgaacaggagccaatggccagcgcccccaaacaaagcagtcgtagcgggtaaaagcgaggcggactggccgattatgggggccgaagcacaatttcaattttcgctatacccttgcagctacgtccggctattcaaagaaggaaccgtcatagagggctacttttgcggctgccacagaagccgggcatacatcacactagccctgagcactggcgcggctcccctacaaaagggaataggtatcaagacccaagaacacatacaaaagttcagcgtaaaccggtttggcgaactcagccctgtcaaacaagaaacccgcacatggcatggagtagcctgcaccagccccgaccaacacgactga

SEQ ID NO: 7290 - RNA, 3171 nt, synthetic construct
  misc_feature 1..3171: note = Cas9 variant
  source 1..3171: mol_type = other RNA
atgaaagccctcaactacatcctcggacttgatctcggaattgcgagcgtcgggtgggcagtcgtcgaaatcgaccaaaacgagcttccgatacgactcatcgacctcggagtaagaaccttcgaacgcgcagaagtcccgaaaaccggcgactccctcgccctagcccggagactagcccgaagtagcagacgactcgtaaggaggagagccgtccgcctcctaaaagccaagagactactaaaacaagaaggaatcctacaagccgatgactttcacagcagccacctcaagccactacccaacaacccctgggaactcagagttaaaggactaaaccacctactcgacagaaaggaatgggccgcagtactgctgcatctcttaaaacatcgcggataccttagccagcggaaaaacgaaagcaaaacggacaacaaagagctcggcgcactactgaaaggagtaagcgaaaaccgacaactgctacaggcacaggccttcagcacacccgcggagatagcgataaagaaattccaacaggaagagggccacatacgcaaccaacgtggtgcctacagccacaccttcgaccgaaatgacctcctggccgaacttaggctgctattccaaaaacaaagagagttcaacaacccatacaccagccaaagcctcgagcaagcaatagcggaactcctgatgtggcaaaaacctgcactttcaggagaagccatcctaaagatgctgggcaaatgcacattcgaaccctcggaatacaaagcccccaaaaactcatactcagcagaatacttcgtctggctgacaaaactaaacaacctccgaatactagaaaacggtgccgatcgaggcctcacagcagaagaaagacagcttctaataaaccagccatttgagaaagcaaagttcacctacgcccaggcacgtaagctactagaactgagtgatttagcgattttcaagggggtccgatacggaaaggacaacgccgaaagcgccacgctcatggaaatgaaggcttggcacgccatcaggaaagccctagaaagcaacggattgaaaaccgaatggaatggccttaaaacgaagcccgaactgctagacaaaatcggaaccgcctttagcatatacaaaacagatgaagacatcagccagtatctcaatggcgaactttcccccgcagtactaaacgccctcctagaaaacctctccttcgacaagtttatcagactgagcctccaaagcctagctaaaatactcccgctaatggaacaagggctacgatacgacgaagcctgcaagcaagtctacggggaccactacggcaagaaagaacagctagaactacggttcctaccaaaaatacccgtcgaggacatccgcaacccggtcgtgcttcggaccctgtcacaagccaggaaagtaatcaacggcgtcgtacggctatacggctcaccagccaggatacatatagaaacaggacgcgaagtcggaaagagcttttccgagcgaagagacatcagcaaacgccaggaagaaaaccgaaacgaaagacagcgcgcagtcgaaaaatttaaggagttcttcccgcacttcgtgggagaacccaaagccaaagacattctaaagatgcgactgtacgaacaacaacatggcaagtgcctgtactcaggcaaagaactggacctaaaccgactgcttgaaaaaggatacgtggaaatcgaccacgctctgcccttctcccgcacctgggacgacagctttaacaacaaagtcctagtcctagcctcggaaaatcaaaacaagggtaaccagaccccatatgaatggctgaatggcaaggagaacgccgaacgatggaaactattccaagcattagtaaacggaagcagattcccatactcaaagaaacaacgaatcctaaccaaatacctcgacgaagacggctttcgggagcgcaaccttaacgacacacgctacgtcgcccgtttcctgtgcaacttcatagaagacaatatgcaacttgtgggccaaggcaagaaacgggtcttcgcaagcaacgggcaaattacagcgctcctcagacgatcctgggggatccaaaaagtacgagaggacaacgacagacaccacgccgtcgatgccgtcgtagtagcatgcagcacacgggcccttcagaaaaagatcaccgactacgtacgctacaaggagatgaacgttttcaccggagagaaaatagaccaagaaacaggcgagatcataaaattccacttccccgaaccatggaaattcttccgtcaagaagtcgaaatacgagtattcagcgagacccctgccgaagacgtcgtaatcgcgctcccagaccggccccaagccaaccacgagttcatacaacccctgttcgtcagccgggcccccacacgaaagatgaccggacaagggcacatggaaactatcaagtccgccaaaagactagccgaaggcctcagcgtatcccgcgtcccgctgacacaactaaaactcaaagacctcgaaaacatggtgaaccgagaacgcgaaaaagcactatacgaagccctaaaagtccgactagaaaagttcaacaacgaccccgcgaaagccttcgccgacccattctacaagaaaggcggacaacaagtcaaagcagtacgcgtagaacaagtacagaaaagcggggtacttgtccgacaagaaaacggggtcgccgacaacgccagcatggtccgagtcgacgtcttcataaaaggaggcaaatacttcctcgtccccatatacacatggcaagtagcaaaaggaatactcccaaaccgcgcagcaacacaaggcaaagaagaggagtactgggacataatggacgaaaccgccatcttccagttctcactttaccaaaacgacctcataaagctcgtcaccaaaaagaaaacaatcttcggctatttcaacggcctgaatcgcgcaaccagcaatataaacatcaaagaacacgacctcgacaaaagcaagggcaaagacggcatctacttagaagtcggggtaaagctcgcactctcactagaaaaataccaggtggacgaattaggcaaaaatatacaaccatgccgctcgatgaagaaacgaccacccgtccgctga

SEQ ID NO: 7291 - RNA, 3171 nt, synthetic construct
  misc_feature 1..3171: note = Cas9 variant
  source 1..3171: mol_type = other RNA
atgccaaaacagaaaagcacccgatatagactcgcactagacctcggaagcacaagcctaggctgggcagtgctccgcctgaacgagcaacacgaaccgaatgccatcatacgagccggagtcagaatcttcagcaacggcagaaaccccaaagacggatcatccctcgcggtaacacgacgggcagctcgggccatgcgcagacgccgagaccgcctcctgaagagaaaagcgagaatgatgaacaaactggtcgaatacggattcttcccagcagacgtagccgaacggaagaaattagagcggatcaacccatacgaactacgggccaaaggacttgacgccccgctgacccctggcgagttcgccagagccctattccacatcaatcaaaggcgagggttcaaaagcaaccgaaaaaccgataagaaagagaacgactcgggagcactgaaagcagccatcagccacctacgacaacaattacatgaacgcaaagccagaaccgtcggtgagtggctatggcagcgcctccaagcaggactaggaacacgagcgagataccgggagtccagagtcgcccaagcaaacggaaaaacgcgaatcgaaaagagctacgatctgtacgtcgacagacaaatgatagcagaagagtttgacgccctctgggcggcccaggccgccttcaacccccaacaattctccgaacaggcgcgtggagaactaagagacgtactactctttcaaagagacctgcgaccggtgagaccgggacgctgcactctcctccccgacgaggaaagggctccactcgccctccccagcgtgcagagattcagaatattgcaagaagcaaaccacctacgcctcctacacccagacctacgggaggagcccttgagcctagcacaacgcgacgcagtagtagacgcactcgaacacaactcgaaacgaacctttgaacaactaaggaaactactaaagctcaacggcacagtcaaattcaatctcgaggatgagaaaagaaaggaactcaaagggaacgcgacaagcgcgacactgagcaaagacggtctcttcggagaaaactggtggaacctcgacgaagccttacaagacgcaatcgtgtggcagctagtaagcgaacaatcagaagaaaaactccaaaactggctacaagccaacacaggcgtcaatgcgacacaagcagaaacaatagccaacgccggcctcccggagggatacggcagcctcagctacaaagcgctcgcacgtataatccccgcgctcagagggacagaagtcgcaaacgggatcgacgtcccgcgcacatacgaccaagcagtgcaagcagcgggattcgcccaccacagcgacctagacagcggattcgactttgaacacagccacgatgaagtagaacgaataggagaacgagtgatagcaagcacaggagaagtaaaacccgtctttgctttcaaacagctaccatactacggaaaagcgctcagaaggcacgtagcattcgccaaagaacacccccgcaacgaagaagaacggtacgggaagatcgcaaacccaacagtacacatcgggctaaatcagctacgagtggtcgtaaacgcgttaattcggagatacggcaggccaaccgaagtagtagtcgaattggcacgcgatctcaaacaatcgcgggagcagaggcaagaagaacaaaaacggcaagcagactaccaaaaacgcaacgaacacattcggcgcgaaatcgcatccatgcacggctgcgcggaagaacgagtaagccacgccgacgtccaaaaatggatattatgggaggaactgagctttgacgtagcagaccgtcgatgcccctactccggtgtgcagatcagcgcccaaatgctactcagcaaccaagtggagatagaacacattctcccatttagtcaaacactagacaacagcttgaacaaccgaaccgtagccatgagacaagcaaacagaataaaaggaaacagaaccccatggcaagcacgagaagactttgaaaggcaaggctggtcatacgattcaatactgcaacgagccgaaagaatgccaaaagcgaaacgataccgattttcaagagacggatacgaaagatggctaaaggaggacaaagacttcttagcaagagcgctaaacgacacccggtacctatcacgagtagccaaaacatacatggaactggtatgcccgctaggcaccagagtcataccggggcagatgacagcactcctaagggcaaagttcggtctgaacgacgtgctcggactaaatggcgagaaaaacagagatgaccacaggcaccacgcggtggacgcctgcgtgataggagtaacagaccaaggcctgctacagaggttcgcccaagccagcgcagacgccaggggaaatggactggaaaaactggtagaaaacatgccagtgccatgggccacctaccgagaccacgtaaaacgcgcaatacagtgcatctgggtttcgcacaaaccagatcacggttacgaaggcccaatgatggaagagaccgcgtatggaatccggaaagacggaagcataagacagaaaaccaaggcagacggttcaacggggcgcgagataacccaccttatcagaataacggagccaacccagaacttgcgacacggtgtcgacgcccaaggacaacccctagcatacaaaggctacgtagggggaagtaacgactgcatagaaatcacgcaaaacgagcaaggcaaatgggaggggaacgtcatcaccacattccaagcatacgatatagtccgcaggctcggcagtaagcaagggccccggagactcagacacccaacactcgcgcaaaccctagacgtatacggaaaacccaaaaagctagtaatgagattaatgatcgacgactgcgtccgcctggagctggacgggaacaagaaaaccctccgcgtcgtaaaaataactggaaacggacaggtattcatggccccagttcacgaagcgaacgtagacaaacgaaacagcgacaaaacggatcccttcgcgtacgtaagcaaatatgccggctcattccagaaagccaaagcacgcagaataacaatctcaccgatcggcgagctgcatgatccgggcttctga

SEQ ID NO: 7292 - RNA, 3174 nt, synthetic construct
  misc_feature 1..3174: note = Cas9 variant
  source 1..3174: mol_type = other RNA
atgagcgacaagtccaagattctgggcttcgacatcgggatcaccagcatcggctgggcctacgtggagggtgaggagctcatcgactgcggcgtccgcatcttcacgaaggccgagaaccccaagacgaaggagtccctggcgctgccgcggcgcgaggcccgcggtgtgcggcggcgcctcgcccggcgcaagggccggttaaacgccatcaagcagctgatctgcaaggagtttggcctgaactaccaagactacatcgctcaggacggggagctgccaaaggcgtacgcgggcaagctgatcaacccctacgagttacgcagcaaggctctgagagagaagttggagaaggaggagctcgcccgcgtgatactgcacatcgcgaagcaccgggggtacggcaacaaacacgccaaggagaccgacgacgccgagtccgggaagatcaagaaggccatctcaaacaacgaaaagatcctgaacgagaagggctaccagtccgccggcgagtacctctaccaggagttcttccagaaggagcgactgcaggaggagaagaaggggaacaacaccaccaaagagttcaagaacgtgcggaacaaggcaggcgactacgagcactgcatcgcccagactcagatgcagaatgaactgcgtctcatcttcgagaagcagcgggagttcgggctgaacttcagcgaggagttcaagaagaaggtgttagagaccgccttctttcagcgccccctcaaggacttctcggacaagatcggcgactgcacctttatcgagggcgccaagagagccccgaaggacagcctgtccgcgatcgagttcgtggccctggggcgaatcatcaacacgctcaagaacctgcagaacacgtctggcgaggtctactcacgggacaagatcaacgagatcctgcagatcgttctcgacaagggggagatcagctataagaagctgcgtgagatcctggacatcgagtccagcgtgcgcttcaaggactccaaactggactacaccaaagagctgaaggaggccgagaagactaagctgtttgagagcaagaacttacagaagttcaagaaggccctaggctccttcgaggggatcagcagggagatcctggacagcatcgccaaggagattatgatcaccaaggataaggagaagctcgcgaaggagctgaagaagttccccctggacgagacgcagatccagaacctctccaacctgagcttctcccagaccatcaatctgtccctcgaggccctgtcccagatcctgcccttcatgcgcggcgagcgggaggacaagtgcctccgctatgacgaggccgtcgagaaggccggcctgaaggaggtggccaagaacaagagcaaggacgacttcctgcccccgctcgagaactatgagccctacctggcgaatcccgtggtcgcccgggcactgagtgagtaccgcaaggtgttgaacgccttactgagaaagtacggcaagatgcacaagatccacatagagttcaccagagaagtgggtaagagcaaggaggagcggaacaagatcgagaaggagcagaaggagaacttcgcgaagaaccaggaggcccagaagcagtgcgagatcttggggctccccatcaacggcgccaacatcctgaagatgaaactgtggcgcgagcagcaggagtcctgcgtctacagcgggaaggagatcgccattgatgacctcaagaatccggccatcctccaggtggaccacatatacccctactcacggagcttcgacgactcctacaacaacaaggtcttggtcttcagcaaggaaaatcagaacaagctgaacaagacccccttcgaggcgttcggcgagaacaaggacaagtgggagaagatcctgtccctggccagtaagctcccaaagcccaagcgccagcggatctataacatgcaattcaaggacaaggagcagggcttcttaacgcgcaacataaacgacaccgggtacatcgcccggctggtgtcccagtggaccaagaattgcctcagcttcgaaaagctgtccgaggacgaggtgagcatcgctggcgagaaggggagcaaggtccacgtggaggtgatctccggctcactgaccgccatgctccgccactactgggggctgggcgacaagaaccgggacaaccacctccaccacgcggtcgacgccatcattatcgcctactccaatgagaaggtaatcaaggccttcagcgattacaagaagcaccgcgagcagaacaaggccaagttctacgcgaaggagattgccgagtccgagtacaaaaagcagaaggtcttcttcgagcccacgaaccactttcggcagaaggtgctggagaagatagacagcatcttcgtcagtaagccgccccgcaagcgcgcccgaggcgctctgcacgaagagaccttctatagcttcgagcgcttatgcaacgacaaggagtacgcgaagaaggagaagatggactacggaggcaaggccgggatccagaaggccatcgccctcggcaagatccggcaggtcggcaccaagattgtgagtaacggtacaatggtcagggtcgacatcttccagcacaaaagcaacggcaagttctacggggtgcccatctacaccatggacttcgccctgggcgtgctgcccaataaagcggtcgtgtccggaaaggacaagcagggagtgattaaggactggctcgagatggacagcaactacgagttctgcttctccctgttcaaggacgacctgatcctcgtgcagaagaaggagatggagaaggccgagctgtgctactacaccgacttcaacagcaacaccgccggcatcaagttcgagaagcacaacaacctgtacgtgaacctcaacgaaaacgagcggaagctgtttacctccaaggaggtggtcaagggtgggaagaagaacgtgtggaaggacaagacgcccaaggagatcgagcagctggagaagaaccggaaaatcatcgggggctttgtgaccatcgaagacctgaagaccttcgagaagtaccaggtaagtcccctgggggaggtgcagaaggccgacttcgcgccccggcaggccatcaccctgaagtccagccccaagcaccgcatcaacaagtga

SEQ ID NO: 7293 - RNA, 3174 nt, synthetic construct
  misc_feature 1..3174: note = Cas9 variant
  source 1..3174: mol_type = other RNA
atgagtaaccgagtgccctatcgcttggcattagacctcggaacaaactcgatagggtggtgcctattggacttgaacgggaacggagacccctgcggggtcagaagaatgggagtaagaatcttccccgacggacgagatccgaaaagcaaagaaagcctagcagcagaccgcagactcgcaagaagcatgagacgaagacgggaccggtacctacggagacggtccgcgctaatgaacgcgctagtcgccgcgggactaatgccggccgatcgcgccaccagaaaagcgctagaaagcgaggacccttgcgagctaagagctagagccctatttgaacctctgaccgcgggccaggtgggcagggcactctttcacttaaaccaacgccggggattcaaaagcaacaggaaggcagcaggggaagaaaacgaggcaggcaagatcaaggcaggcataagtgcgctaaaggcagagatagaggccagcggagaaacaacactcggagcatggctcgcagcacgacaccggaagagggaaaccgtcagagctagactagacggagccggtgcaaaggcaagctacgaattttatccagaacggggactggtacacgacgagttccaagcaatacgaacagcacaggcgctacaccaccccgcggtaacggcagagcaatgggacagggtcgagagcgtgatatttagacagcgaccactcaggcccgtgcgcccgggaaagtgcaccctgttcccagaccaggagcgagctccatgggccctgccagtagctcaggagttccgaatcctaacagaaatagggaacctaaagctctaccgaccgggagaagaaccgcgagaactgtccgcggaccaacacgcacagcttttcgcaaagctatgccgaagcgccgatctcacgttcgaaaagataaggaaggaactaaaactcgatccaggcttaaaggtgaacttggaaggagaaaagagagacaggctaaaaggcgacgcggtcacaagcgcgctatccgcaaagaagaggttcggtccaaagtggaacgcattaaccccagacgatcgacgtgacatcgtcggaagactaatagaggccgaggacgaagccgagctcgcaggatggttagagagcgtccacggactcccaagcgagaacgcagcacatacggcggcctcgcccggcctaccagacggatactgccgattgagtgaaaaagcgctagtgaaattggtacccctgatgcgagaacaacgcctcaggtacgacgaagcggtactagcactcaacttgcaccacagcgatttcaggcctgaagggttactcgatgagctgccatactacggggaacccctggaaaggttcatagccttcggaagcggagaaccgagcgacccgccagaacaacacctaggaagattcccgaatccgacagtacacatcggtctaaacgaactacggaagttagtaaaccggatagtcgaacgatggggcaaaccggcagacatcgtagtggaactggcgcgggatctaaaaaggtcacgggacgagagagacactatacaaagagaacaggcccaaaaccaacgcaaaaacgaggaccgatttgcgaaaataaaagagttaggaatcgacccgaggccggatagcatgctaagacttaggctgtgggaagaactccccaaagtgggcgtaggccacgtctgtgtatacacaggagaacccataggaatcaggagacttctcgaaggggacgtcgatattgatcacatcctcccattctcgagaaccctctcggacggagctgacaataaaatagtgtgcgtaagacgagccaacaggttcaaaagagaccgcagcccctgggaagcatttggggtaacagcggtcgacgggtacgactgggcagcgatcgcgcagagggcagaggaactacccaagaacaagcgatggcgattcctcccagacgccatggaccgattcgaaggagaaaggggattcctcgacaggcagctagtagaaacgaggcatctatcaagagtggcccgacaatacctagcgagcatagtggacctgaacaaggtacgcgtggcccccggcaagctcacagcgatgctaagggcaagatggggactcaataaaatactgagcgacggaaatctcaaaaacagaagcgaccatagacatcacgcgatagacgcagcggtcctgggaatgatagaccaaagactcgtacaattggtagcacaggcagcagcgcgggcggaggcaaacgaactcgaaaggctgttcgacgggctgccagacccttttgacgggctagcggccacgagcttcggtgaccaagtcagagagaaaattagggggataacagtaagtcaccgagctgaacacggatggcagggccggatgcataatgacaccgcgtacggaccagtagaagcagtcaacggagttcacaccgtagttacccgaaaaccactttcaggactcacagcgaaggatttccccaatatcagagacagagtactggctaaggcactcgaagaccacgtagcagcagaggccgccgcaggacgatcattcggggacgcactaggcagctttaaatggggaggccaaccagttagacgtgtgagaatgctagacgtattaggcaacccaatacccatacaagatcccagcggaacggtcttcaaagtgtacaagggcgactctaacgcatggtacgaaatattaagggatccaaggggaagatggacaggcaagatcgtgagtacattcgaagcataccgattacacagagagtggttagccgaaacgggcggagatagtggtaggggatcgggcgtgttcctggattgggccgccaaaagggtagtaggcgaagccgggacgccgctattcaggctgtttaaaggcgatctactagccctaggtgaagcaccagacagacgcatcgtaagagtcgtgaaattcagcgaaggtcaagtagcacttgcactgcatctcgaagcagggaacctaaaagcgagagatgcggacaaaggcgacccattcaagtaccaatactgcagcccagacagtttaaggaagcaggcagccaggcccgcaggggtcgacctattgggctatgtccatgataaaggaccgttagaatga

SEQ ID NO: 7294 - RNA, 3174 nt, synthetic construct
  misc_feature 1..3174: note = Cas9 variant
  source 1..3174: mol_type = other RNA
atgcgaagactcgggctggacataggaaccaactccataggctggtgcttaatagaggacgacaagaaaatagtcgacataggtgtacgcatcttcagcgacgggagggacccaaaaagtggggcttcactcgcagtcgaccgacgagacgcccgcgcgatgaggcgcagacgagaccgttacctcggccgccggtcagcattcctacaagctctcgtagtacacggcctaatgccagccgacgccgacgaagcgaagctagtcgcagaccgcgatccctaccagctcagagcaaaagccctccacgtcgcactcgaaccgttcgaaataggcagagccctgttccacctgaaccaacgcagaggattcaaatccaacagaaaagccgaccgaaaagccaacgccggcgaagatggcaaaatagcagaaggcgcaaaagcactcgaccaagccatgagcgaagcaggcgtagacacactaggacagttcctcgcacttaaagaaacgaaaagagtcaggctcgggagcgatggacaagcgtacgacttctacccacagcggcgacacatagagtacgagttcgaccgcatatggaaagtacaaagcgaataccacccggcactcttgaccgaagccgcccgcgccgcgcttcacaggatactattcttccaacgaccactgaaagcgcaagaagtgggcttctgcaccttcgcgggcgtaaacggaatagccgccaacgaacgcagactaccgaaagcccacccactgtttcagcagcgacgactgtacgaagaagtaaaccaactacgcatagtctcagcgggagcagcagacagaccactgacactagacgaacgcgaccgattaattctccgactgcaagaccgaaagaaagtgagcttcgacacacttgcaaagaaagacctccggctagccgacggcgaacgatttaacaaagaatccgaaaaccgcaaagaacttatcggggacgaagtccgcgccgaaatgagcgacaagaaaagatttggaaccagatgggtccactttggactcgatgaacaactgcggatactagccaaactgcaagatgaggaaaacccggaagctctcctagactggctcaggtcagaatacggcctcgacgaagcagcagcagaatcggtcgcaaacgccagactacctgaaggatacgggcgcttcggcgagacggcaacacgactactactcgacgcactcaaggccgaagtcataacgtacgacaaggccgcacttcgggcattcggtcaccacagcgacttccgaaccggcgaggtcttagaccgcctaccatactacggagaactactaacgagagaaatcgcacccggtaagcccgaatacggagacccactagaacgccagtacgggaaaatcaccaacccaaccgtacatatcggactccgtcaactcgaaaaacttgtcaacgcagtcatcgcagtccatggccgccctgatcaaatcgtagtcgaactagcgagggagcttaaactcaacgaaaaagaaaaggatgaacacaagcgacggataaaacgcgacaccgacgccgcaatcgcacgcggccgcaagctagcatcagaaggcttcatcgacaacggtgccaatcgcatgctaatgcggatctgggaggaactcaacccagcaaacccactggacagacgctgtccctactgtgccgaaccaatcggaatcagagcactattctcaggagaagccgacattgaccacataataccatactcacgctcccttgacgataacgtagggaacaaagtcgtagctcaccgctcctgcaatcgagccaaaggaaacaagaccccatacgagaaatggggaccgcacattgacccagaaagatgggagcgaatcagcgaccaagtcgcgaggctccacaaatcgaagcagtggcgcttcggacccgatgcaatggaacgaatcgatcgagatggagggttcctagcgcgccaactgacggacacccagtacctctcccgagtagcgggcaaatacctgagatcgctctaccccaccgcacaaagcggacgagtcgatgtgatccccggtagaatgacagcaatgctccgccgaaagtggggcctcaacagcctactcccagaccacaactacgtcgaaaatgaacattcaaacgcacccaaaaaccgcctagaccaccgtcaccacgcaatagacgcagcggttgcagcggtgacgaccttgtctctaatgcaacagatagcagacgccgcgggtcgcgcagaagacaaaaacctagatagactcttcgaagacatcccacagccatggcccggttttcgagaagaactaggagaagccttgcgatcaaccactgtaagccacaaggcagaccacggacgcaaacgaaggcccagccgcgaccgagacgtcacggccgcacgcctccacaacgatacagcctacgggctcacaggagacgttgcagccgacggtaagacccccatcgtcgtgcaccgcgtacccctcgcatccctcaaaccagccgatctcatagacccactccgaatcccggacccggtactccgggacgcgctatacgctgccacccgcgatcgaaccggaaaagagttcgaacaagccctgacccaattcgcacggcaccacccactattcaaaggaatcagacgagtgcgcgtgcgcgaaccactaaacgtaatccccatccgcgacgcggcagggagggcctacaaggcctacaagggagacgcgaacgccagattcgatgtctggcgcctcccaaacggaaaatgggtctccgatatcgtctcaatgttcgatgcacactgcatggcagacaagtccgaccgaagaccccacccagcagcaaagaaggtactctcacttcggcaaaacgacatggtcgcaattgaaagaagcggagtcacgcagatcgcccgtgtggtaaaattctctactaacggatccatcgcattggccgccgacaacgaagccggcgccctaaaggcaagagacgccgcgcccaacgacgtggatcccttcaaatacatattctcgtccggcggcggcctaaagaatttaaaagcgcgccaagtacgcgtcgatcccctgggtcgagtattcgacccaggaccgcgcgagtga

SEQ ID NO: 7295 - RNA, 3177 nt, synthetic construct
  misc_feature 1..3177: note = Cas9 variant
  source 1..3177: mol_type = other RNA
atgaagaactcatacatcctgggcctcgacgtggggatcgccagcgtcggctacgggctgatccacagcgattcgaagtcagtgatcgacgccggtgtgcgacttttccccgaggctaatgtcgagaataacgaggggcggcgagccaagagggggtccaggcggctcaagcgccggcgcatccaccgcctggaccgcgtgaagtacctgttagcccagtaccacctgatcatcgacgacaaaatccccaagagcaccaacccctacgccatccgggtgaaaggcctgtccagcgccctaagtaagagcgagctggtcatcgcgctgctccacctcgccaagcgccgggggatccacaacgttaatgtcgtcatggatgagaatgagtccaccaacgagctgtccacgaaggagcagcttaaggagaacgccaaacagctggagaaccgctacgtgtgcgagctgcaactcgatcggctgaacgagcagtacaaggtgcgcggcgagaggaatcgcttcaagaccgaggacttcgtacgggaagcccgccagatactcaccacccagcagaagtaccacgacatcgacgagcacttcatcgagcagtacactcacctcctggagaccaggcgcgaatactacgaggggcccggcaaggggtcccagtacggatgggaaggcgacctcaagcagtggtacgagatgctcatggggcgctgcacctacttccccgaggagctgcgcagcgtgaagtacgcttacaccgccgacctgtttaacgctctcaacgacctgaacaacctcgtgatcgcccgcgacgagaacgagaaactcgagtacttcgagaagtaccacatcatcgagaacgtcttcaaacagaaaaagtccccgacgttgaagcagatagccaaagaaatcgacgtgaaggagagcgacatcaagggctacaggatcaccaagaacggaaagccccagttcacctccttcaaactgtaccacgacctaaacaagatcttcctcgacaaaaagaacctggagaacatagaactcctggacgagatcgcgttcatcctgacgttgtaccaagaccccctgtcgatcaaagaggccctggaccagttacaggacctgctgacggagtccgagaaggaggccatcgcccacctcaatggctacaccggcacccaccgcctgagcctgaagtgcctccacctcctgattgacgagatgtggcagaccagcaggaaccagatggaggtgtttacggcactgaacctcaagccccagaagtaccagctatccaagcagaagcagatcccgaagaagatggtcgaggagttcatcctctcacccgtggtgaagaggtctttcattcagagcatcgaaatcgtcaacaccatcattaagaagtacgggctccccgaagagatcattatcgagctggcgcgggagaaaaactccgaagaccgccggaagttcctgaaccgcatccagaaggagaacgagaacacccggaagcaggtcgaggaggtgatccgcgagtacggcaatcggaacgcaaaggggttagtggagaagatcaaactgcaccagatgcaggagggcaagtgcctgtacagcctccagaacatccccctggacgatctgctccgcaacccgtctcactacgagatcgaccacatcatcccacggagcgtgtccttcgacaacagcttcaacaacaaagtcctggtgaagcaggaggagaactccaagaaggggaaccgcactccctaccaatatttaaacagcaatgagtccgtgctcagctacgtccagttcaaacagcacatcctgaacctgtccaagagcaaggagcggatctcaaagaagaagcgcgagtacctcctggaggaacgggatatcaacaagttcgaggtgcagaaggagttcataaaccgcaatttagtcgacacgcgctacgccacccgggagctcgtccagctgctcaagagctacttctccgcgaatgacctggacgtaaaggtgaagacaatcaacggcagcttcaccaactacctgcgcaaggcctggaaattcgacaagtcccggaacaagggcttcaagcaccacgcggaggacgccctgatcatcgccaacgtctcctacctcttcaagcagagcaaagagctgaaggaggccaacgccattctggagaacaacaacctctccctgaataagaacaaggactcgaaaaacttgctcacggagcaggactatcgaaagatgttcgagatccccaagcaggtccaggacatcaaggactacaaggacttcaagtactcgcaccgggtcgacaagaagccgaaccgccagctgatcaacgacagcctgtactccaccagggaggtgaacgaaaaccactacatcgtgcagaccgtgaaggacatctacgcgaaggacaacaccaagatcaaggacctcttcctgaagactccggaaaaattactcatgtaccagcacgacccccaaaccttcgagaagctgatgctggtcatcaagcagtacggtgaggagaagaaccccttcgccaagtactacgaggagaacggcgagtacctcaccaagtacgccaagaacgagaaggggccgaccatcaagaggctgaagtacatcggcaagaaagtgggaacgcatctagacatcagcaccaatttctccggcgcaaagcggaaggtggtccagctcagcatcaagcccttccgcttcgacgtcttccactccaaagcgggctaccatatgctgaccctgacctacatggacataaagaagaaggagaagcactaccagatcctcaaaaatgaataccaggccctgaaggagcggtacaaggtgccctcagacgcccagttcatcggttctttctactacaatgacctgattagcatcaatgacgaactgttccgcgtcattggggtgaacaactccacgaggaacgtggtcgagctgaacatggtggacatcaactacaaggactattgcgacctgatggggatcaagaagacccctcgcatctttaagaccatcaccaagaagaccggcaagattgagaagtacagcacggacatactggggaaccaattcaaggtgaagccatccaagagcccccaactgatcttcaagcggggcgtcctctga

SEQ ID NO: 7296 - RNA, 3180 nt, synthetic construct
  misc_feature 1..3180: note = Cas9 variant
  source 1..3180: mol_type = other RNA
atgagacgactcggacttgacataggtaccaactccataggctggtgcctcacacaaggccccggcgacgaagccgacgggatcgtggacataggcgtcaggatcttcagcgacggccgagatccacaaagtggtacgagcctcgccgtcgaccgccgagacgccagagcagctcgacgccgacgagaccggtatataggcagacgaagcgcattcctagataccctagtcgcacacggcctcatgccggcggacgcagacgaagcaaaactggtagccgcactagacccctacacactccgcgcccgagccctagaggcaccgctaacaccccacgaaatcggacgagctctattccaccttaatcaacgaagaggatttaaaagcaacagaaaagcagaaagaaaaaccaacgacgcggacgacggaaaaatagccacagccgcatacgccctcgacagagccatgctcgacggagggttcgacaccctaggccaattcctcaacgcccaagaaacaaaacgcgtccggatggacggcgaagcccaggggtacgacttctacccccaaaggcgccacgtagaatatgagttcgaccgaatatggacagaacaagcaaaacaccacccggcactcctcacggaaacggccagatatgcgctacaccgcatcctcttctaccaaagaccactcaaagcacaagtcgtcggaaaatgcaccttcgtccactctgaagaccgactagcaaaagcccaccctctgttccaacaaagacgcctctatgaagaagtcaaccagctagaagtaaccaccccaggagaagcaaatcgaaagctcacactggacgaacgagaccgactcgtaagagaactatcccacaagaaagctatcgcattcacctcgctagcggccaaaattaagctcgaacccggacagagcttcaacaaagcatcagaaaccagaacacaactggcaggcgacgaggtacgcgccgtattaggcgataaaaagcggttcgggcccgcctgggaacactttgaccgagaccgacaatggaccatcgtagaaagactactagaagaggaagacccagatgccttacacgccttcctcacacaagactgtggcctcgacgatgaacacgccgcagcaacagccaaaacatcactccccgaaggatacggacgactcggcgccaccgcaacagcccgcatactagccgaactacaagcagaagtgataacatacgatgaggcggtccgcagatgcggatggcatcacagtgaccacaggaccggagaaattctcccacagctcccatactacggcgaactcctaacccgcgacatccctcccggcacacaggatcccaacgacccaccggagaaaagatggggacgaattacaaacccaacagtacacatcggactaaaccaggtcaggcaattagttaatgctatagtagcagtgcacggacgacccgaccagattgtagtagaactcgctagagaactcaaactgaacgaaaaagacaaagaagaacataaccgccgcatacgacgcgacaccgccgcagcaatcaaaaggtcggaaaaactcactcaagaaggcttcccagacacaggagccaacagaatgttgcttcgcctatgggaggacctcaacccagcaaaccctctagaccgccgatgcccatactgcggcgcccccataggaatgagagcactattcgcaggcgaagcagacgtggatcacataattccatactctagaagcctcgacgactccgccggaaacaaggtagttgcacaccgatcctgcaatagggcgaaaggaaacagaaccccctatgaaaaatggtctgacgacccggaccgatgggacgcaataacggcacaggtagccagactacacaggtcaaagcaatggagatttggccccgacgccatggcccgcgtagaaaaagacgggggcttcctatcacgccaactcacagacacccaatacttaagccggctcgcgggccgatacctgagctccctatacccaaccaaggaggaagggtcagtctatgtcatccccggacggatgacagccatgcttcgaagactctggggactcaacgacatcctctcggaccacaacatagtagaaaacaaacacagcaacgcccccaaaaacagactcgatcaccgacaccacgccatagacgcagcagtcgtagctgtgtcaacacgctctctaatgcaacgaatagcccgcaccgctggacaggccgaagaccggaacctagacagactattcgaagggctggacccaccgtggcccggcttcagagaccaactacgtgaccgactactagcggtcacagtaagccacaaggctgaccacggccggaccggcaccccagtccctggcaaagacgcaaccgcgggccgcctacacaacgacacagcatatggcctgacgggcgaaacaagcgcaaagggattacccatagtagtccatcgcgtgcccctgacctccctcaagcccgcagacattacggatccagatcggatccctgacccggtgctaagagacgcgattgaaagagccacagcaggcaaaatgggcaaggactttacagatgccctagcaaaatttggacgatcaggagcccaagaaacagacagaaagggcgaacgactcttccgcggaacccgacgggtaagagtccgagagcccttaggggtgataccaatagcagatgcatccggccgggtatacaaagcatacaaaggcgactccaacgcacgattcgacgtatggagactaccggacggaaagtgggtctcagacattgtcagtatgttcgacgctcaccgcccagaccaaggcgacagacggccacacccagccgcaaagaaagtcctaagcctgcgacaaaacgacatgatagcaatagaacgcgacggggcaccacgagaaatagtacgcgtggtcaaattcagcacgatagggtcggtacagctcgccgccacaacagaagctgggccccttaaagcacgggacgcctccccacccgacgtagaccccttcagatacataaactcctccgcgggcggactaaagaaaatcaaagccaggcaagtccgtatcgatcccctcggccgaatattcgacccgggcccccgctga

SEQ ID NO: 7297 - RNA, 3180 nt, synthetic construct
  misc_feature 1..3180: note = Cas9 variant
  source 1..3180: mol_type = other RNA
atgatcgagaggatcctaggcgtagacctaggcataagctcgctaggatgggcaatagtcgaatacgacaaagacgacgaggcagcaaaccgaatcatagactgcggagtcagactgttcacggcggcagagacccctaaaaagaaagaaagcccgaacaaagcgcgaagagaagcacgcggcataaggcgagtcctcaaccggcggcgagtacggatgaatatgatcaagaaactcttcctccgcgccggactcatacaagacgtggacctggatggggagggcggcatgttctattccaaagcaaacagagcagatgtctgggaactgaggcacgacggactatacaggctacttaagggtgatgagctggcccgagtactcatccacatagcaaaacaccgaggctacaaattcatcggcgacgatgaagcggacgaagaaagcgggaaggtaaagaaagcgggagtagtactacgtcaaaactttgaggctgccggatgccgaaccgtcggagaatggctatggcgggagcgaggggccaacggaaagaaacgaaacaaacacggggactatgagatctccatccatagggacctgctagtagaagaggtagaggccatcttcgtggcccaacaagaaatgagaagcaccatagcgacggacgcactgaaagcagcttacagagaaatcgccttcttcgtaagacccatgcaaaggatagaaaagatggtcggacactgcacttacttcccagaagaaagacgcgcccccaaatccgccccgaccgccgaaaagtttatcgccataagtaagttcttcagcacagtaataatcgacaacgaaggctgggaacagaaaatcatagaacgcaagacactagaggaactgctggacttcgcagtcagcagggaaaaagtcgagttcagacacttacgaaaattcctggacctctcagacaacgaaatcttcaagggtctacattataaaggcaaacccaagacagcaaagaaacgagaagccacactattcgaccccaacgaaccgacagaactagagttcgacaaagtcgaagccgaaaagaaggcgtggatcagcctacgcggggcagctaaactgagagaagcactaggtaacgagttctacggaagattcgtagcactcggcaaacacgcagacgaagcaacgaaaatattaacatactacaaagatgaaggacagaaaagacgcgaactaacaaaactcccactcgaagctgaaatggtagagcgactcgtgaaaatagggttcagtgacttccttaaactcagcctaaaagcaatccgcgacatactaccggccatggaatcaggtgcacgatacgatgaggccgtacttatgctgggagtaccgcacaaagaaaagagcgcgatattacctcccctcaacaaaacggacattgacatcctcaacccgacggtcatacgagccttcgcacagttccgaaaggtggcgaacgcactcgtacgcaaatacggggccttcgaccgcgtccacttcgaactagcgagagaaataaacaccaaaggagaaattgaagacatcaaagaatcacagcggaagaacgaaaaagaaaggaaagaagccgccgactggatagccgagacgagcttccaagtaccgctaacacgcaagaacatcctgaagaaacgcctgtacatccaacaggatggtcgctgcgcgtacacaggagacgtcatcgagctggagagactgttcgacgaagggtactgcgagatcgaccacatactaccacgaagccgcagcgcagacgactcgttcgccaacaaagtcctgtgcctagccagagccaaccaacagaaaacagaccgcacgccctacgaatggttcggacacgacgcagcaagatggaatgccttcgaaacaaggacatcagccccatcgaatcgcgtaaggaccggcaaaggaaaaatcgaccgactcctcaagaagaacttcgacgaaaactccgaaatggccttcaaggataggaacttaaacgacacacggtacatggcacgcgcgatcaaaacatactgcgaacaatactgggtcttcaaaaactcccacacaaaagcgcccgtccaggtaaggtcaggcaaactaacaagtgtactccgttaccaatggggattggaaagcaaagaccgagaatcacacacccatcacgccgtcgacgccatcataatagcgttcagcacgcaaggcatggtccagaaactaagtgaatactacaggtttaaagaaacacaccgagaaaaagaacggccaaaactagcagtgcccctagccaacttcagagacgcagtagaagaagccactaggatcgaaaacacagaaacggtcaaagagggcgtagaagtaaagcgcctactaatcagccgcccgccacgcgcaagagtaacaggccaagcacacgagcaaaccgcaaaaccctacccaagaatcaaacaagtgaaaaacaagaaaaagtggcgcctcgcccccatcgacgaagaaaaatttgagagcttcaaagcggacagagtagccagcgcaaatcaaaagaacttctacgaaacgtccaccatcccaagggtggacgtataccacaaaaagggaaaattccacctagtaccaatatacctacacgaaatggtcctgaatgaactgccgaacctgagcctaggaacgaaccccgaagccatggacgaaaacttcttcaaattcagcatattcaaagacgacctcatcagcatccagacacagggcaccccgaaaaagccagctaaaataatcatgggttacttcaaaaacatgcacggggcaaacatggtactgtcatccatcaacaacagcccatgcgaaggctttacgtgcacaccagtaagcatggacaaaaagcacaaggacaaatgtaaactatgcccagaggagaaccgaatcgccgggcgctgcctccaaggattcctagactactggtctcaagagggtctcaggcccccgaggaaggagttcgaatgcgaccaaggagtgaaattcgcactagacgtcaagaagtaccaaatagacccactcggatactactacgaagttaaacaggaaaagcgcctgggcaccataccccagatgagaagcgcaaagaaactcgtgaagaaatga

SEQ ID NO: 7298 - RNA, 3180 nt, synthetic construct
  misc_feature 1..3180: note = Cas9 variant
  source 1..3180: mol_type = other RNA
atgagcaaacgactgaggtacaggttggcacttgacctcggaacaaacagcataggcttctgcttgctggacctcaacggggacggccgcccgtgcggcgtcagaagaatgggagtacgcattttcccagactttagcaaactgcaacagtccctagcagcagacagaagactcgcacgctcaatgaggcgcagacgggaccgatacctaagacgacgaaaagccctaatgaacgcgctagtggcagcagcactaatgccagcagatccaaaagcaagaaaagcgctcgaagccctcgacccatacgaactacgcgcggcggcagtagcaggcccactcccagcccaccaactcggacgagcactattccatctcaaccaacgcaggggatttaaatccaaccgtaaagctgcgggagatgaaaacgaagcaggcaaagtaaaaagcgggataagcgccctaaaagcagagctcgcagcctcaggcgcaggaaccctcggacaatggctggcagcgagacacgcaaacagacaaccagtaagggccagactcacgggtacaggcgcaaaagccacatacagcttctacccagaacgagcgctagtacacgaggaatttcaggccatccgagcagcgcaagcaccgcaccaccctggcgtcacagcagaacaatgggatagaatagagtcagtgatattccaccaaagaccgctaaaaccagtgaagcccgggaaatgcacattatacccagaggaagaaagggccccgtgggcgttaccaatagcacagcgattccgaatcctccacgaactacacaacctaagaatcgtgcgcccaggccagggagaagaaggcctatcacccgccgacttcgacaggttctttgaccgactgtgcagaaaaggagacctgacattcaaaaccctagccaaagaactcaaattaccaccagacgcacgtataaacctagaagatgacaaaagagacaggctgaaaggagacgcaacagccgacgcactaagcgcagaaaaaggtaaacgaagacgaataggcgcagcatggcacagtttcccagcggatcggcagcgtgagatagtaggcaggctaatagacgccgaggacgaaggggagctcgcggcctggctcgtagaggaactaggcctaccctgggaagtcgcaatcttaacggccgaacgcccaggactaccagacgggtactgccggctatccgaaaaagcactcgaacaggtggtacctctaatgcatgaggagcacttgccctacgacgaagcagtacgggcgctaggactccaccactccgaccatcgcaccggagagttcctagatgaactgccgtactacggcctcccgctcgaaagattcatcgccttcggaacaggggaggcagacgacccacccgaattaaggatcggccgattcccgaacccaaccgtgcacgttgcactaaacgaactacgccgcgtcgtgaaccgaataatacgtagatggggaaagcccgaggaaatagtggtagaattagcccgcgacctaaaacaaagcagagcagaccgagacaagacccaaagagaacaagccgataaccagaagaaaaattggacaaggacgcagcaactacgcgagctcggcatggaaccgacaggtgaagcactactaaggctacgactctgggaggaactcccacgaataggatcggcccatgtatgcgtatacacaggacaaccaatctccatgacgcagttactacaaggcgacgtagacgtagaccacatcctcccattctccagaacactggcaaatggcgcagacaacaaaatcgtatgccacaggagggcaaatagaatcaaacgcaaccgaacaccatgggaagccttcggagtcgtatcggcagacggatacgattgggccgccatcgcagaaagagcggaaagcctccccaaaaacaagcgctggcgcttcctccccaacgcaatggaacgattcgaaactgaacggggatttatagacagacaactggtagaaaccagacacctaagccgcgtcgctagggaatacctcggatgcatagtaccactagaaaaagtccgagccgcacccggaagactaaccgccatgctcagaggccgctggggcctaaatagcatcctctcggacgcgaacctcaaaaacagatcagaccacagacaccacgcggtagacgcagcggtgctaggcgtcatcgaccaacgcttagtacaaagagtagccgacgcagccaagagagcagaagaaaaagagctagaaaagctattcgacggcctcccagaccccttcgaagggttacctggccccagcttccgcgaccaagtccaagaaagggcacaaggaataatagtgagccacaagccagaacacggatggcagggaaggatgcacaacgacacggcatacggcccagtggaaagactgccagacggaacacacagagtagtgacaaggaaaccactcggcagcctagcggaaaaagacttcgggaacatccgagaccgcgcactagcagcagcactcgaaagacacgtggcagaacaagcggcacaaggaagatcgctaggagaggcactatcgtgcttcacctggaccggcggggaagtcagacgggtaagaatgctggacaaactaggctcgccagtagcagtacaggacgacgatggacacacattcaaactatacaaaggcgacagcaatgcatggtacgaaatactacgagacggaagagggcgctggacaggacgcatagtgagcacgtacgaggcataccgcctccacgcagagtggctggccgagcgcggagacggaggcagaagcgacgccgcgttcccggactgggcagcaagacgcctctgcgcagggatcggaaaaccactattccgactcttcaaaggcgacatgctggcctttggaaccgcaccgaaccgagaaataatgaaggtcgtaaaattcagcgagggacggatcgtgttcgcaggacacagagaagcaggaaacttaaaagaaagggacgcagacaaagatgatccatttaagtaccgaacatgcagccctgaagcgctcaggaaagctcaagcgaggccggtcggcgtcgacccagccggcttcgtacacgacagaggaccccttgaatga

SEQ ID NO: 7299 - RNA, 3180 nt, synthetic construct
  misc_feature 1..3180: note = Cas9 variant
  source 1..3180: mol_type = other RNA
atgggaatcagattcgcgttcgacctcgggacaaacagcattggatgggcggtctggcgaacaggaccaggagtattcggagaagacacggccgcaagtctagacggaagcggagtcctgatcttcaaagacggaagaaaccccaaggacggccagagcttagcgacaatgcgaagagtaccacgacagagccgaaaacggcgggacagattcgtactcaggcgccgcgacctactagcggcactgcggaaagctggactcttcccggtagacgtggaggaagggcggagactagcagcgacagacccgtaccacctaagagcaaaagcactagacgaaagtctcaccccacacgaaatgggaagggtcatcttccacctgaaccaaagaagaggattcagaagcaaccggaaagcagaccggcaagaccgagaaaagggcaagatagcagaagggagcaagcgcctcgccgagaccctcgcagcaacaaactgcaggacactcggagagttcctatggtcacgacaccgcgggaccccaaggactagatccccgaccaggatacgcatggaaggagaaggcgccaaagccctatacgcattctatccgacaagggagatggttcgagcagaatttgagcgcctgtggaccgcacaatcccgcttcgcaccagacttactcacaccagaaagacacgaagaaatcgcaggaatcctttttcgacaacgtgatctcgcaccgccgaagatagggtgctgcaccttcgaacccagcgaaagacgattgccaagagcactacctagcgtagaagcacgggggatatacgaaaggctagcccacctcagaataacgaccggccccgtaagcgaccggggactaacacgccccgagagagacgtactagcgagcgcattgctagccggaaaaagcctcacattcaaagcggtccgaaaaaccctgaaaatcctcccccacgccctcgtcaactttgaagaggccggggaaaaaggactagacggggcactgacagcgaagctcctctcaaagccagaccattatggggccgcgtggcacggcctatcattcgcagagaaagacacgttcgtaggaaagttgttagacgaagcagatgaggaaagactaatcagacgcctcgtaaccgaaaacaggctaagcgaggacgccgcgcggagatgcgcgtccataccactagcagacggatacgggcgattagggagaacggcaaataccgaaatcctggcggccctcgtagaagaaaccgacgaaaccggaacagtggtcacgtacgcagaggcagtacgtagagccggcgaaagaacgggaagaaactggcaccacagcgatgaacgagacggggtcatactagatcgactaccgtactacggggaaatactacaacgccatgtagtccccggaagtggtgagccggaggagaaaaatgaggcagccaggtggggccgattggccaacccaaccgtccacatcggactaaaccagctaagaaaagtcgtaaaccgactaatcgcagcacacggacgtccagaccaaatagtcgtggaactcgcacgagaactcaaactaaaccgagaacaaaaggagcgactagaccgagaaaaccgaaagaaccgcgaggaaaacgagagaagaacggcaatcctagccgaacacggacagagggacaccgcagagaacaagatcaggctgaggcttttcgaagaacaagcaagagccaacgccggcatagcactgtgcccctacaccggaagggcaatagggatagccgaactcttcacgtcagaagtagaaatcgaccacatcctcccagtatccctgacactagacgacagtctagcaaaccgtgtcctatgtcggagagaagcaaacagggagaaaagaaggcagacaccattccaagcatttggcgccacaccagcatggaacgacatagtagcaagggccgccaaactaccgccaaataagcgatggcggttcgacccagcagcgctggaaagattcgaacgagaaggaggatttctaggaagacaactgaacgaaaccaagtacctatcaagactagccaaaatctacctcggtaaaatatgcgatcccgacagggtctacgttactccaggcacgctaacaggactgctaagagcaagatggggattaaactcaatcctcagtgattcaaactttaagaaccgaagtgaccaccgacaccatgccgtggacgccgttgtcataggagtactgacgagagggatgatacaacgaatagcccacgacgcagcccgggctgaggaccaggacctagatcgagtctttcgcgacgtaccagtccccttcgaagatttcagggaccacgttcgcgaacgagtcagcacaatcacggtagcggtcaaaccagaacatggaaaaggaggagcactacatgaggatacgtcatacgggctagtccccgacacagacccgaacgccgcactgggcaacctagtcgtacgaaaacccatccggtcactcacagcaggcgaagtagacagggtgcgggatagagccctcagagcccgactaggggcactcgcagccccattccgagacgaatcaggccgggtaagagacgccaagggactggctcaggccctggaagccttcggagcagaaaatggaataaggcgagtgcggatactaaaacccgatgcgagcgtagtcacgatagcagacagacgcacaggagtaccgtacagagccgtagccccaggtgagaaccaccacgtggacatagtgcaaatgcgcgacggaagctggaggggattcgctgcaagcgtgttcgaagtaaaccgaccagggtggagacccgaatgggaagtaaagaaactgggaggtaagctagtcatgagattgcataagggagacatggtcgaactaagcgacaaagacggccaacgcagggtcaaggtcgtacaacaaatcgaaatctcagccaaccgagtaagactatcgccacacaacgacgggggcaaactacaagaccgccacgcagatgcagacgaccccttccgatgggacctcgccacgataccgctactaaaagacagaggatgcgtagcagtaagagtggaccccatcggagtggtcacactaaggagatcaaatgtatga

SEQ ID NO: 7300 - RNA, 3183 nt, synthetic construct
  misc_feature 1..3183: note = Cas9 variant
  source 1..3183: mol_type = other RNA
atggctgtcaaatccctaaactacatcctcggcctagacctgggaatcgcttcatgcgggtgggcagtagtagaaatggacgaacaagagaacccccttcggctaatcgacgtcggtgtccgcacatttgaagaagccgaaaaccccaaagacggctcaagcctagctgagacccgacgactagcacgcgcgcaacggcgcttaatatcccgacgcgccaaccgaatgaataaactacggcgcctacttaaacaggaaaacgtattgcaagccaacgactacgatgaaaaaggactcatcatcgggctcccaaaccaagcatgggagctgcgcgcacaagggctcgaccgaaaactcgagcccaaggaatgggcagcagtactcatccatcttgtgaaacacagaggatacctgtcccagcgaaagaacgaatcccaaaccgccgacaaagaattgggcgcacttctatccggaatgaaccacaatcaccaactactacaaagccaaagcaaccagtaccgcacccctgccgaactcgccatcaaacaattcgcgacacaagacggccacatacggaaccagcgcggcgcgtacacccacacttttaaccgccttgacctacaaaatgaattaaaccaactcttcgacgctcaaacccgtctagggaacccccacgtctccggaagtctcaagacggcaatcaacgacctcctgatgaaccaaaaggccgcgctaagcggcgacgcaatcctagaaatgctaggcagatgcacattcgagcccagcgaatacaaagcagcaaagaacacctattccgccgaacggttcgtctggcttgggaaactcaccaacctaaggattcaagacaatggcctggaatctgccctttctagagaacaacgggaacttctactcaatgaaccctacaacaaaacaaaactcacttatcaacaggtacgtaaactcctccgcctccccgaaacagccttcttcaaagggctacgctacggcaaggacaatgcagaatcagcaacactcatggaaatgaaaagctaccacgccataaggaaatcactagaaaacaaatcgctaaaatcagaatgggaaaagctcaaaacacagcccaagctactcgaccttatagggacagccttctcaatatacaaaaccgacgatgaaattgcaggatgtctcaagaatcaactccccgaaaacgtaatcatagccctccaagagcaacttaacttctccaacttcatggaactaagcctcaaggcactagaaaaactactccctctcatggagcaaggcctccgctacgacgaggcttgcacacaaatatacggcaatcgccacgaaaagatcgccgacaaaacggaaaaattcctccccaacattcctgcggacaaactacggaatcccgtcgtgctccgtacactgacccaagcacgcaaagtaatcaacgcgataatccgacgctacggaagccccgccagagtccacatcgaaactggccgcgaagtcggaaaatcattctccgacagagataaactaaagaaacaacaggaagagaaccaagaacagcgacgccgagccatcgacgaatggaaacaattcttccccaacgcagcccacgaacccaaagccgtcgacatacttaaactccgcctgtaccaactccaacaaggcaaatgcctctatagcggcctgcctattgacgtgagaagattacccgaaaaaggctatgtcgaaatcgaccacgcactacccttctcacggacgtgggacgattcattcaataacaaaatcctagtcctagcttccgaaaaccaaaacaaaggcaaccaaacaccgtacgagtacctaagaggagcagataacagcgaatcatggcgcctgttcgtcgaaaacgttcagaactgccagttctcacccaataaaaagcagaaaataatggccaaacagctcgacgagaagggcttcctcgagcgcaacctaaacgacacgagatacgtgtccagattcctctgccagttcatctccgaatacctccacctcaccgggaaaggtaaaaagagagtattcgctagcaacggccagatcaccgctctgcttcggggcagatggggactcagcaaaaaccgtgaagaaaacgaccgacaccacgcggtggacgcagtagtcgttgcgtgctccaccgtggccatgcaacagaaaatcacccaattcgtcagataccagaaaggcaacgtgttcaccggcgaaagaatagacaaagagacaggcgaagtgatctcgatacacttccccacaccctgggaacacttccgcgaagaagtcatgataagggtcttcgacgacaaccccttacgcacccttcccgaaaaactcccgaacagaccagaagcactacacgaatacgttatgcccctattcgtctcccgcatgccaacacgcaaaatgaccggacaagggcacaaggaaaccataaagagcgcaaagagactcgacgagaaaatatccgtcctcagagtccctctcacccaactaaaacttaacgaccttgaaaacatggtaaacagagaacgagaaccggcactgtacgaagcactcaaagcccgcctcgagcaattcaaaaacgaccccgccaaagccttcgccgaaccattcttcaaacagggcggccaacaagtgaaggcagtacgagtggagatcgtacaaaagagcggaatgctcctcaggaaaatcaacggggtggcagacaatggctcgatggtcagagtagacgtcttcgagaaatctgggaagttctacctagtccccatatacgcatggcaagtcgccgaaggcatactaccgaatcacgccgtcgtacactccaaagacgagtcggactggatcctaatggacgaatcctaccactttaaatttgccctgtacaaaaacgacctactcgaggtccaaaccaagaaaggatgcatcatgggatacttcgcctccctcgaccgtgccaccggggccatcactatccgcgaacacgatcgcgacaaaaagaaatgcaaagacggcgagcaccgcagcatcggtgtgaaaatggccagtagcttcaaaaagctgcaggtcgacgaactcgggaaaaacatacacgagacccgaagtagaaaacgcccaaatatcggttga

SEQ ID NO: 7301 - RNA, 3186 nt, synthetic construct
  misc_feature 1..3186: note = Cas9 variant
  source 1..3186: mol_type = other RNA
atgcatacactgccctacacattaggcctagacatcggcatagcatccgtaggcgcagcactcttaagcgatgaatcaatcctgggaatgcacgtacgaaccttctcggcagccgagacagacaaagaaggagacccactaaacaaaatccgacgagaggcccgttccgcaagacgacgaataagacgacgcgcccatagactcctacggctccgccgcttactcaaacggactggcctgatctcagacaccagcctcgaagtcctcaaaacctcaaaaaccccttggcaactcagatccgaaggcctagaccgccttctctccccaagcgaactcgctgcggcgctctaccacattgtaaaacatcgcggattccagtccaacagaaaagctgaactcaagaccgacgccaaagcagggcagatgcttagcggcgtctcagccaaccaacaactaatgagagacaagtcatacagaacaatagccgaaatggtatgcaaagacgacgcgttcaaagatcacaaacgcaacaaagggggttcctaccgcaacaccttcgcgcgaagcgacctcgcggacgaactcaaaacattactaaagaaacagcgcgaatacgataacccactcgccacccccgaactcgaagaagccgttcatacgctactgatggcccgcagacccgtcttcaaagacgacgatatagaaaaactcgtcgggttctgcacttttgagcacggagaaaaacgcgcgcccaaagccgctttctcctctgaacgcttcatatggctcggcaagctcaacaacttacgcctgatctaccccggcgagcaacgctccctaacccctgaagaacgatcccaaataataaatctcccgttcacccaggcatccgtgaaattcagccaaatccgcaagaaactcgacctaccggaatacgtccggttcaacttagtccgatacaaacccggagaggagaccagcaaaagcgaaacggccacattcttcgaggccaaagcctttcacgaactacgcaaaacctaccgagaatcaggcatttcagaactgtgggaacgggaccaacacgacccacaaagactcgatcagatcgcgaccgccatagcggtctatcgtgacgacgagcgcatccgaaacgaattaagtccacatacgatagaaaacgaagtagtggaagccgtcctcaactgcgacttcacccaattcataaacctgtcccttaaagccctaaacaaaatactaccgtacatggaacagggacaacgctacgacgaggcttgcacttcggccggctaccaacaccacagcccacaacagaatgaggaaaaatcagggcgcatacccccacccgacaaaaacgtcatcagaaatcccgtagtgtaccggtccctcaaccaagccagaaagctaatcaatgcaatcaccaagcgatacggcgcccccgctgccatccacctcgaaatggccagagacctatctaaacccttcagtgagaggaaaagtatcgaaagagaacaagaaaaatatcgcaaacaaaaggttcagctaagaaacgaatacatagaacacttcggaaccgagccaaacggactaaaccttctaaaattcagactatacaaagaacaagacgcgcagtgcgcgtacactcaaaaagccctcgatctgagccgactaaacgaagccggatacgtagaagtagaccacatactgccatacagccgatcatacgacgactctctccttaacaagacactcgtcctcaccgaggccaaccgcgacaagggtaaccgcacccccttcgagttcatgggtggcgacgaccaatcacaacactggcagaagttcgtccgatgggtacagatgaaccccaagatccgccaagccaaacgcaaccgatacctcagaaaagacttctcggaaaaggccgcccgcgagttccgcgacagacacctaaacgacacacggtacataggcagagaactgaaagcgatgattgaatcccacgtccagtggcacccggactcaaagtcaaaagattgctgtgtcgtactctccggacaactgacagcactacttcgaggacgatggggcttcaataaagaccgcgcggccggcgacttgcaccacgctgtggacgcagccgtcgtagctgcagcgactagaggcatgattcagcgaatggcaagacactcgaaatttcacgaactcaaaaacgtacgcacaagttatgccgatcctgacacaggcgaagtcgtgaacctcgcagccgccagagacctagaaaaacacttcccactaccgtgggacaacttccgcaatgacaccctagcatacctaaacccgagcgccataagcgccgacgagtcggcccaggaaggccacagaggcgtaagagtcagccgcgcccccacacgacgtaaactcggagccgcacaccaggaaactataagaagcaagggaaaggacaacatcctcctggaacaaggcctaagtgccgtcaaaacacccctgagcaaactaacccttaagaacatcgaaaatatggtaggctacgaggacccaagaaacgcagccctcgtcaaggtcctccgagagagactagaagccttcggcggagacggagcaaaggcattcgcgcccaaccaaccaccagtatacaaaccctccaaacccggcaaacaagcccccgaaatccgcagcgtgaaaatggcaagcaagagcaaaggcgcactacacgtacgagagggcctcgccgactccggccgaatgataaggatcgacatatatgaaaccaaaaacggatatgtgggggtccccatatacgtatccgacaaagcaaggtccaaactccccaaagcctaccccaagaagggagaagaccgtgccaactggcctgaagtcgacacaaacgacaacttcctcttctctctctacagcaccgactggatagaagccaaaacgaagaaagaaacgatcgccggctacgtcaaaagttacgatatctttgatggtcgactacttgtctacgcccacgacaacaagaaagttgtgaggaaactcacgctctcggccctcgccgacctacagaaactgcacgtatcaatactaggcgacctctacaaaggaggcacacccaaatgtagccccctcagaaaaggccaagaactatga

SEQ ID NO: 7302 - RNA, 3186 nt, synthetic construct
  misc_feature 1..3186: note = Cas9 variant
  source 1..3186: mol_type = other RNA
atgctccggctcggcctggacataggaagcacatccatagggtggttcctatacagaataaccaacggtatgatagccgaaatcatagactgcggcgtccgcctattttctgacggacgggacgcaaaaacaggcgtctcctcggcagtagagagaagaaacgcacgagccttgcggcgccgtcgagaccgatacctcaggcggagagcagcactaatgcgacggcttgcagccgcgggtctgatgcccgaagacccttcccaggcaaaaccactagaactactcgacccataccgactcagagcagacgccctagatagacgattagaactcacagagctcggacgcgcactgttccacctcaaccagagaagaggctttaaaagcaaccgccagacagaccgcgggaacaatgaaggaggcaaaatcatcgacggatcagccagactcgaccaggcaatgatggcagtgggagccagaacctacggcgaatttctacacctaaggagaagccaagcagaagacctcagaagagtcccaagcgtccggacccgccttacactccgcagtgtggacggcggaaaggcagagaccggatacgacttctacccagaccggagacacctagaagaagagttcaacaaggtgtgggccgcacaagccgcgcaccacccagttctcacagacagtctccggcacgaagtgttcgagacaatctttttccaaaggccattaaaagcccccgcggtaggacggtgtctcttctttcccgagccacgactaccccgggcccacccactcacccaacgcagagtgctctatgaaacagtcaacgcactacgaatacggacagaaagcggcgccgcagtccccctaggaaaagaacagcgggacaaagtcataatgctgctggacggaaaagcgccagtaaaagctatcgccagcgcaaaactatcactaaaagcaatcgcaaaacacctaaaactacgcgacggacaaacattcacgttagaaaaaggacgggactacatagcgtgcgaccccgttagggcctccctatcccacccagacaggttcggcccaaggtggagcgtactagaggcggaagtccaagccgaaatagtcggccgaatccgcgacgacgacgacaccatggcgctagtagaatggcttaaacaagtccacggactagacgacgcacacgcacgagctaccgcagacgcaccactacccgaaggctacggacgcctcggagaaaccgccacccgaaaattactggactgcctaaaggcagaagtactcacctactcagaagccgtaggaaaagccctggaccaacaccactcagatcggcgaacgggggagatcctcgaatccttaccgtactatggcgaggtcctccaagcacacgtcatcccaggaacgggagagccgcaccacgacgatataacccggttcggcagaatcaccaaccccaccgtccacatcggcctcaaccagctccgccgactcgtgaaccgcatcatagcaaggtacggcaagccagcagaaatcgtcgtggagcttgccagagacttgaaacaatcaaccggacaaaagaaggccgccatcgccttaaacctgaaaaacagaaaggctgctgaagcgagatcggctctactaacagaatggggcgtaccagacaccggagctaaccgaatgtacgtccgactatggcaggagttacacgaagacccaatgatgcgtagatgcccatacacgggaacaataatcagcccgtcactactcttctccggtgccatcgacatagaccacatcctaccatacagccgaacactagacgatagtacagccaaccgaaccctctgcatgaaagaggcaaatcggcaaaagcgcaacaaatcgcccagcgaggcccgaagagatggtatgcgcatatgggccctggaagacgacaacctacgtcacatcccagagttcaaacgatggcgattcgccgaagacgcaatggcacgcttcgaaggcgaaagagactttgaggccagagccctcgtcgacacccagtacctctcacgcatctccaaagcatacctggaaacgttatacgacggggccgacggcaaatcccacgtctgggtggtcccaggccggctgaccgaaatgctaagaagacactgggggctaaacggcatactaaccgacccgctcagagacgtcacaaaggagaaaaacagaatggaccaccgacaccacgcaatcgacgcagccgtagtcgccgctactgacagaggtctaataaaagcgatggccgaacaagccaggacagacgtcgatcaagggcgcgaagccttagcatcgtcaatcatgccaccctggccaggattcagagaagcagtagcagcccaagtggaccgaataatagtaagccacagaccagaccacggaaggatcgacctcacaactcgaatgaaaggccgggaccaaaccacagggccactacaccgggacaccgcatacgggctaacaggccaaagcgaaaaaggggtacccctagtagtaacacgggaaccatttgacaacctgaccccaactatgatagggaaaatacgagacgagcccctaaaagctgccctcgccgcagtgacagctggaaagaaagacgacgcatttgccgaagcactagcacactttcgggatagaccaggtccataccacggaatacgcagagtgcggctcatagaaccaatcagcgtcgtcgaaatacgagacgcctctggccgcgcttataaaggttataaaggcaactccaaccactgcttcgaagtatggcgactaccaggaggcgcaatcacagaacacatcgtatccacatttgacgcgcatcaaccaggccccgaaccgcgaccccacccagctgcaaaacgactactcaggttattcaaaagcgacatggtaaaactagacgacagtaaattcgggcccgtgattgcaaccgtcgtaatgttcgatcgaaacggcaaaatcagcctcgtcccacatacagccagcaatgcacgaaagagatgcgaaaagtacaaggaagacctgtacctaaggttcaccgccaggaccctaattgaggcgggcgcccgcagaatcatagtcgacgaaaccggacatttcagggaccccgggaggaagggatga

SEQ ID NO: 7303 - RNA, 3189 nt, synthetic construct
  misc_feature 1..3189: note = Cas9 variant
  source 1..3189: mol_type = other RNA
atggccgaaaagcaacatagatggggcctggacataggcactaattcaataggatgggcagtcatagctctaatcgaaggcaggcctgccgggctcgtagcgaccggcagccgcatattctcagatggccgcaacccaaaagacggaagctcacttgccgtggaacgacgcggaccacgccagatgcgacgccggcgggaccgatatcttcgacgaagagaccgctttatgcaggccctcataaacgtaggcctcatgcctggagatgcagcagccagaaaagcactcgtgaccgagaacccatacgtcctgagacaacgaggactagaccaagccttaacgctaccggagttcggcagagcactcttccacctcaatcaacgacgcggattccagtcgaaccgaaaaacagaccgcgcaacagcgaaggaatccggcaaagtcaagaacgccatcgcagcattccgagcagggatgggaaacgcgcgaactgtcggagaagcccttgcacgccgcctagaggacggaagacctgtcagagcccgcatggtgggacaagggaaagacgagcactatgaactgtacatcgcacgcgaatggatagcccaagagttcgatgccttatgggcttcacaacagcgattccacgcggaagtcctcgcggacgccgcacgcgacagactccgcgcaatactactgttccaacgcaaactactccccgtacctgtaggaaagtgcttcctagagcctaaccaaccaagagtcgcagcagcgctaccgagcgcccaacgcttccgcctcatgcaagaactaaatcacctccgggtaatgacgctagccgacaagcgagaaagacccctaagtttccaagagagaaacgacctcctcgcccagctagtagcgcgaccgaaatgcggcttcgacatgttacggaaaatagtattcggggcaaacaaagaggcataccgattcacaatcgagagcgaacgcagaaaagagctaaaaggatgcgacaccgccgcgaaactagctaaagtaaacgcactaggcacaagatggcaagcactaagtttagacgagcaagaccgcctggtatgccttcttctcgacggagaaaacgatgcggtcctcgccgacgcactaagggagcactacgggctgacagacgcacaaatcgacaccctgctcggactgagcttcgaagacggacacatgcgcctcggcaggtcggcgctcctccgggtactagacgccttagaaagcggacgtgacgagcaaggcctgcccctctcctacgacaaagcagtagtggcagccgggtacccggcacacacagcagacctcgagaacggcgaacgtgacgcgctaccgtactatggcgaactactgtggcgctacacccaagacgcgccaaccgccaaaaacgacgccgagaggaaatttggcaaaatagcaaaccccaccgtacacatcgggctaaaccaactcagaaaactcgtcaacgcactcatacaacgatacggaaaaccggcacaaatcgtagtagagctagccagaaacctcaaagccggcctagaggagaaagaacggataaagaaacaacaaaccgcgaacctagaacggaacgaaagaataagacaaaaactacaagacgctggggtcccagacaacagggaaaaccgcctaagaatgagactatttgaagaactgggccaagggaacggcctcggcaccccgtgcatctactcaggccgacaaataagcctacaacgactattcagcaacgacgtgcaagtagaccatatactacccttttcgaaaacacttgacgattcattcgccaacaaagtactagcgcagcatgacgcaaaccgctacaaaggaaacagaggaccattcgaggcttttggagcaaaccgagacggatacgcttgggacgatatccgagccagagcggcagtattaccaaggaataaacgaaatcgattcgcagaaacagcaatgcaagactggctgcacaacgaaacagacttcctggccagacagctcaccgacacagcatacttgagccgcgtggcgcgacaataccttactgcaatatgtagcaaagacgatgtctacgtgtcacccgggcgactcaccgccatgctacgggcaaaatggggactaaatagagtcctagacggcgtcatggaagaacaagggcgaccagcggtcaaaaaccgcgacgaccaccgacaccacgccatagacgccgtagtcataggagccacagacagagccatgctccaacaagtagccacactagccgcacgcgcacgcgaacaagacgcagaacgactcataggagacatgccaaccccgtggccaaacttcctagaggacgtacgcgcagcagtcgcacgatgcgtggtctcccacaaacccgaccacggaccagagggcggcctgcacaacgatacagcctatggcatagtagcagggcccttcgaggacggtcgctacagagtaaggcaccgcgtaagcctgttcgatctcaaaccaggagacctaagcaacgtccgatgcgacgcgccactacaagccgaactcgaacctatcttcgaacaggatgacgcccgcgcgagagaggtcgcactcacagcgctcgccgaacgttaccgacagcgaaaagtgtggctagaagaactcatgagcgtcctaccaattagaccgcgcggcgaagacggcaaaacacttccagactcagccccatacaaagcatacaaaggagacagcaactactgctacgaactattcataaacgaacgaggacgatgggacggtgagctaatcagcacctttagagccaaccaagccgcataccgacgattccgaaacgacccagccagattccgccgatacacagctggcggacgccccctcctcatgagactatgcataaacgactacatcgcagtaggcacggcagcagaaagaacgatattcagggtcgtaaaaatgtcagaaaacaagatcacactcgcagaacacttcgagggaggaacactcaaacaaagagacgccgacaaagacgacccattcaaatacctaactaagagccccggagccctaagagatcttggcgcaagacggatcttcgtcgacctaatcggcagagtcctagaccccggaatcaagggagattga

SEQ ID NO: 7304 - RNA, 3189 nt, synthetic construct
  misc_feature 1..3189: note = Cas9 variant
  source 1..3189: mol_type = other RNA
atgaacctgaactacattctgggcctcgacctggggatcgcaagcgttggttgggccgtcgtagaaatagacgagcaagaaaatccacaacgcttgatcgacgtaggagtcagaacgttcgaccgagcagaagtactcaagaccggggaaagcctcgcattagcacgccggctcgcccgctcatcacgacgcctggtaaagcgcagagcggaacgaataaagaaagccaaacgtctcctaaaagccgaaaacctactactaagcgccgatgaaatactgcccaacgaagcctggcaactccgcgtcaaaggcttagaccaaaaactggagcgccaagaatgggcagccgtcctcctccacttgctcaagcaccgaggctacttgtcacaaagaaagaatgaatcaaaaagtgaaaacaaagaattaggcgccctgctaagtggagtagcaataaaccatcaaatattgcaatcggccgaataccgaacacccgccgagatagccgtaaacaaattccaggccgaggaaggccatatccgcaaccagcgcggcgcttacacacacaccttcagccgactagacctactcgccgaaatggaactcctgttccaacgccaggccaccctaggcaacccacacacctccaccaaactgcttgaaaacctcacggccctcctcatgtggcagaaacccgccttagccggagaagcaatcctgaaaatgctgggcaaatgcaccttcgagcccaccgaatacaaggcagcgaaaaactcctacagcgcggaacgcttcgtttggctaaccaaactaaacaacctgcgcatattggaacaaggtgcggaaagagcactgacggacaacgaacgattcgcacttctggaccagccatacgaaaaagcaaaactaacttacgcacaagtacgaacgctcctcggactatcggacgaggcaatattcaagggactccgctaccaaggggaagacaagaaagccgtagagacgaaaacaacgctaatggaagtcaaagcataccaccaaatcagaaaagcactcgaaggcctagacctgaaagcagagtggaacgagctcaaaaacaacccggcactactagacgaaatcggcaccgcattcagcctctacaaaaccgacgacgacatccaccgataccttgacggcaaattatctgaaagcgtcctcaacgcgctcctcgaaaacctaaacttcgacaaattcatccaactatcacttaaagccctccaacagatactaccccttatgctacaaggtcaaaggtacgacgaagcagtaagcgccatatatggagaccactacggaaagaaaagcgacgagatagatcgactcttaccgaacataccaacagacgaaatacggaaccccgtagtcctaagaaccctaacacaggcccggaaagtaataaacgccgtagtaaggctatacggctcaccagcacgaatccacatcgagaccggcagggaggtaggaaaaagctatcaagatcgaaagaaactagaaaaacagcaggaagagaaccgaaaacagcgcgagaacgccgtcaagaaattcaaagaatatttccccaacttcgtcggggaacccaaaggaaaggacatactcaagatgaggctctacgaactacaacaagccaaatgtctctactccgggaaatcactcgaactataccgactacttgaaaaaggctacgtggaagtagaccacgcactcccattcagcaggacctgggatgactcgttcaacaacaaagtgctcgtcctagccaacgaaaaccagaacaagggaaacgcaacaccctacgaatggttagacggcaaaaacaactcagaaggctggcaacacttcgtcgcacgggtgcaaaccagcggcttctcctacgccaaaaagcaacgagtactcatacaagaactggatgaaaagagcttcatcgaacggaatctgaacgacacgcgatatgtcgcaaggttcctctgtaaccacatcgcagacaacatgctcctcaccgggaaaggcaagaggaaagtattcgccagcaacggacaaatcacagccctgctccgtggctgctggggactccaaaaggtccgagaaaacaatgaccggcaccacgccctcgacgccgttgtggtagcgtgctcaaccaaaagcatgcaagacaaaatcaccaagttcgtaaaatacaaagaaggcagactctttaaagacaagaaagacggagtatacaaaggagaaagaatcaatcgggaaacaggggaaatcataagcctacactttccaacaccatggaaattcttcaaagaaaacgtcgaaatacgcatcttcagcgaaaacccaaagctcgaacttgagaacagacttcccgactacccacagtacaaccacgagttcgtacaacccctgtttgtgagccgcatgccgacgcgcaaaatgacaggccaaggacacatggagacggtaaaaagcgcgaaacgactagataaaggcctcagcgtcttaaaagtcccacttacacagctaaaactctcagatcttgaaagaatggtcaaccgagaaagagagatggccctctacgaagcattaaaagaatgcctcgaacagttcggaaacgacccagccaaagcattcgcggaacccttctacaagaaaggcggagcactcgtaaaggccgtacgagtcgagcaaacccaaaagtctggcgtcctcgtacgcaacggcaacggcgtagccgacaacgcaacaggaagcatcgttagagttgacgtatttaccaaaggcggaaaatacttcctagtgcccatatacacgtggcaggtcgcgaagggcatactgccaaacaaagccgtgatccaaggcaaagacgaatcagaatgggaagagatggacgaaaacgccgtcttccagttctccatgcacaaaaacgatctgatcaaggtcaaaacgaagaaaggagaaatcttcggctacttcaacggactagaccgcgcaacaggcagcatcgagattgaagaacacgatctggaaaaatccaaaggcaaaaatggctcccatcgcggcctaggagtaaaaacggccttcttcctagagaaataccaagtagacgaactaggcaaaaacatacggccgtgtcgccccaccaaacggcagcacgtgaggtga

SEQ ID NO: 7305 - RNA, 3192 nt, synthetic construct
  misc_feature 1..3192: note = Cas9 variant
  source 1..3192: mol_type = other RNA
atggagaaccacatcaactaccgcctgggcctcgacatcgggatcgccagcgtgggctggtctgtcatcaacctggacaagaagcggatcgaggacctgggggtgcgcatcttcaacgccgcggagcaccccaaggacggcagctccctcgccctgccgcggcgcatcgcccgggggcgccggcgcctgctccggcgcaaggcctaccgggtgaagcgcgtccgtaagctgatcgtggactacaacatcctgaccaaagaccagctcaacgatctgttcaagcagaagtgccagaatagcgtgtgggagatccgcgtcaaggccctggacaacaaggtgaccaacgaggaatgggctcggttgctgataaacctgtgcaagcgccggggcttcaagtccaaccgcaagaacgaagccgacgacaaggagacaaagaaggtgatcaacagcatcaagtcgaacatcaagggcatgaaggagagcgggtcccggactatcggcgagtacatctacacccaaaccctcagctccggggacatcagcaagtcctttaggaacaaggacggccagtacaacaactgcgtcagccggaagatgatagaggaggagatcaaaatcctgttcaagaagcagcgcgagctggggtgcgagttcgccagtgaggagatcgaggagaagtacctcgccatcttcaacagccagcgccccttctccaagttcgaggacctggagaagatggtgggcttctgcacgttcgagaaggcgtccaaggagcggcgcgcccccaagtgcagtatcagcgcggaggaatttgtgctgtacgacaacatgaacaagctcagcatactgaacaagggcgacacccggaagctgaccaacgaggagcgcaagatcatcgtcgagaacgccttcaagaacaaggagatcaagtactccaagctccggaagatcctgaacctgagcaacgacgagcgcttctccaccctcagctactccaacaagacggagctcagcaagaccgagaactccaagttcgtggccctgaaggggtaccacgagattaagagcgcgatcgagaagtccttcggcaaggacacctggaaccgggtgaagaacaaccgcaccatgctaaacgacatcgcctacgtcctgagcatcgccaagacggacgaggacatcatcaagcagctgtccctccggaacatcccccgcgagatcatcgacgccgtgctggggctgagcttctccaagttctccaatctctccatcaaagccatcgagaagatcctgccgtacctgaaggacggccagcagtacaacgaggcgtgcaagagcgccggttacgacttcaaggccacttacaacggggagaagtcctacaagctccccctgatcgatatcgacgagatcgtgaaccccgtcgtgaaccgggccctgagccagacccgcaaggtgatcaacgccgtcatcgaccggtacggctcccccatcgggatcaacatcgagctcgcgagagacctggccaagaacttcaaggaccggagcaagatcaagaaggagcaggaggagaaccgcgccaacaaggagaagatcaagaacgagctgaagatgctcatgaataaggagccgaccagctccgagatcctgaagtaccggctgtggaaggagcagcgcgaggagtgcgcctactcccaggagcggatctacattgaggacctcttcaaggtgggccagtacgagatcgaccacatcatccccttctcccgcagcttcgacgactccctgaacaacaaggtgctggtcaaggccgcggagaaccagcgcaaggccaaccggatcccatacgagtacttcgggagcgacgaggaccgctggtaccggttcgaggtgtgggtcgagcagtccagcctgtccttcaagaagaagaacaacctcctgaagaagcgcttcagccgggaggactccatcgagttcaaggaccgcaacttagtggacacgcagtacataagccggtacatctccaacttcatcaagagccgcctcatattcaaggagtccgacagcaagcagaaggtgatcaccatcaacggccgggccacctcctacctgcgcgcaaagtggggcctgctcaaggtacgggagaacggggacaagcaccacgcgctggacgcaaccgtgatcgccgtggccacgcagggcatggtccaggagatcagcaagtacagcaaggcccacgagctgaagtacatccgccagggggacgagttcatagacatcgagaccggcgagatcgtgaaggtgaaggaccacaagcacctctccaaggaccggctgcccgagccgtggctggggttcagctccgagctccgcctgcgtctgagcgagaaccccatcgaggaactcaagaagtcccccatcagcacctacgacgaggagtttatccgcaagaccgtccggcccatcttcgtgtcacgcgtgccgtaccggaaggtcacgggccgcctgttcgaggagaccgtgtacagccccaaggcgttcatcgacgagggcttcatcgccaagaagaaacttcaggacctcaccctgaaggacttcgaaaacatctacaactacaactccgacaagaagctgtacgacgccctccgggagcgcctggaggagtacgggggcaacgccaagaaggccttcgcggaggagttccgcaagcccaccaagacggggaagctgggccccatcgtcaagagcatcaaggtgaagaccaagatcccgttcaaggacgggatcgacctcaacggcggcaaggtgaagaaggacgggctggtgcggatagacatttacgaaaaggagggcaagtactacgtcgtgcccgtgtaccgcctggacatccagcaggggaacatccccaagaaggccgccgtcgccaacaaggaggagaaggactggatcctcatggacgagtcctacaacttcaagttcagcctgtacaagaacgacctgatctacatcaagtacgactcaaagggcgagtacttcggctactacgacgggttcgaccggcacaccggcgccatcaccctcgagcgccacgacaacagcgagcggtaccgcgggatcggcatcaagacgggggtgaaggagatcttcaagtacaacgtggatgtcctgggccggtactacaaggtggcgaagtga

SEQ ID NO: 7306 - RNA, 3192 nt, synthetic construct
  misc_feature 1..3192: note = Cas9 variant
  source 1..3192: mol_type = other RNA
atggagaaattccactacgtactcggtctcgacctcgggatagcgtccgtaggatgggccgccatagaaattgataaagaaaccgagacctcaataggcctcctagactgcggggtacgcaccttcgaacgagcagaagtcccgaaaacaggtgacagcctagcgaaagcacgccgagaagcccgctccactagacgcctcatacgccgccgcagccaccgactgctacgactgaaaagactcctaaaaagagaaatattccggcaaccagagaccttcaaagacctacccatcaacgcatggcaactccgggtaaaaggactagactcacgtctaaacgaatacgaatgggctgcagtgctactacatctagtgaaacaccggggctacctgagccaacgcaaaagcgagatgtcggaaacagatagcaagagcgagatgggcagactcctagccggggtcgccgaaaaccaccagcttctgcaacaggaacagtacagaacacccgccgagttagccctcaagaaattcgtaaaacatttcaggaacaaaggtggtgactatgcccacaccttcaaccgcctagacctccaagcggaactacatctcctgttccaaaaacaaagagaactgggaaaccccttcacctcacctgaactcgagcggcaagtagacgacctactaatgacccaacgctcagcactccagggggatgccatcctgaaaatgctcggccactgtggctttgaacccgagcagttcaaggcggccaaaaataccttctccgccgagcgattcatatggctgacaaaacttaacaacttacgcatccaagaccaaggcaaagaacgcgccctaacagccgacgaaagaacaaaactcctagacgagccttacaagaaaagcaaactcacctacgcccaagtacgaaagctcctgagcttaccacaaaccgccatattcaaggggctcaggtacgacctcgaacatgacaagaaagccgaaaactccacactaatggaaatgaaatcataccacaacatccgccaaacgcttgaaaaatcgggcctaaagacggaatggcaatccatcgcgacacaaccagagatcctagacgcaataggcaccgcgttttccatatacaagacagacgaggacataagtcacgaattgaaaacctgccgcctcccagagaacgtcctgaacgagttactcaagaacataaacttcgacggcttcatccaactctcgctaaccgccctacgcaaaatactccccctcatggaacaaggataccggtacgacgaagcgtgcacccaaatttacggcaaccaccattcaggctcactacagcaagagagcaaacaattcctcccgcacatccctatagacgacgtacgaaacccagtcgtcttcagaaccctcacacaagctcggaaagtcgtcaatgccatcatacgccgctacggatcgcccgcccgtgtccacatagagatggcaagggaattaggcaagtcaaaatccgaccgcgaccgcatagaaaaacagcagcagaaaaataagaaagagcgtgagaatgcggtagcaaaatttaaggaagactttcccgacttcgttggcgaaccccgaggcaaagacatactcaagatgcgactctacgaacaacaacatggaaagtgcctctactcaggacacgacatcgacatcaatcgactgaacgagaagggttacgtggagatagaccacgcactaccgttctccagaacctgggacgactcccaaaacaacaaggtcctagtactcggcagcgaaaaccagaacaagcgaaaccagacccccgacgaatacctcgacggagcaaacaactcccaacggtggctggagtttcaagcgagagtacaaacctgccacttcagctacgggaagaaacaacggatacagctagcaaaattagacgacgaaacagaaaaaggcttcttagaaaggaacctaaacgacacacgttacatagcccgcttcatgtgccaattcgtccaagaaaacctatacctaacaggtaaaggcaagcgtctagtgttcgcatccaacggaggaatgaccgcgactctccgaaacctctggggactccgaaaggtaagagaagataacgacagacaccacgcactcgacgccatagtcgtagcatgctcaaccgcgagcatgcagcagaaaattaccaaagccttccaaagacacgagtcaatcgaatacgtggacaccgaaaccggcgaagtcaagttccgcatcccccaaccctgggacttcttccgtcaagaagtaatgatcagagtgttctccgaccaaccctgcgaagacctcgtagaaaagctctcggccagaccagaagccctccacgacaacgtaacacccctcttcgtatcacgagcccccaaccgcaaaatgtccggccagggacacctagaaaccataaaatcagctaagaggctaagcgaggaaaactccatggtcaagaaaccactaaccaccctcaaactcaaagacatccccgaaatcgtaggctacccaagcagagaaccacaactctacgcagcactaaaaacccggctcgaaacacacgacgacgaccccataaaagcattcgcgaagcccttctacaaaccaaacaaaaacggcgaactaggcgcacttgtacgatctgttagggtcaaaggcgtacagaacacaggagtcatggtccacgacggcaaggggatcgctgacaacgccacgatggtccgcgtagacgtctacacaaaagccgggaaaaactatctagtaccagtatacgtttggcaagtcgctcagggaatactccccaaccgcgccgtaacatccggaaaatccgaggcagactgggacctcatagatgaatcgttcgagttcaaattcagcctcagccggggtgacttagtagaaatgattagcaacaaaggacgaattttcggatactacaacggcctcgaccgggcgaacggatcaatcggcatacgagagcacgacctcgagaaatccaagggaaaagacggtgtacacagagtcggcgtaaaaaccgcaacagccttcaacaaataccacgtggaccccctaggcaaggaaatccaccgctgcagctccgagcctagaccaaccctgaaaatcaaatcaaagaaatga

SEQ ID NO: 7307 - RNA, 3192 nt, synthetic construct; identical to SEQ ID NO: 1507
  misc_feature 1..3192: note = Cas9 variant
  source 1..3192: mol_type = other RNA

SEQ ID NO: 7308 - RNA, 3195 nt, synthetic construct
  misc_feature 1..3195: note = Cas9 variant
  source 1..3195: mol_type = other RNA
atgagcgagtgcgtgacaagaagaatactcgggattgatctgggcattgcgtcatgcggctggggcgtaatcgaagtcggagaagcaagcgggagcatcatcgcatccggcgttaggtgcttcgacgcaccactaatcgacaaaacaggagaacccaaaagcgcgacaaggcgcacagcccgcggacaacgacgaataatcagacgacgaaggcagaggatgaacgccgtgaggcgcctactagcagagttcggcgtcctaacaggcagatcaccagacgccctgcaccaggcgctcctaagactcagccaatccgtagcaggatcacaagtcacgccgtggaccctacgcgcagcagcacatgaacgcaaattaaccaacgacgaactcgccgttgtactaggacacatcgcgcgacaccgaggcttccggagcaactcgaaaaacgacggcggcgccaatgcggccgacgaaacctccaaaatgaaaaaggcaatggaaaccacccgcgaaggcctagcacgataccacagcttcggagcgatgatagcatccgaccccaaattcgcagatcgaaaacgcaaccgcgacaaagattacagtcacaccgccaagcgctccgacctagaagacgaagtacgcacgatatttcgatcacaaaccagatttggcagcttagtggcctcagaaaagctatcccaagcgttcgctgacgcggcgttcttccaacggcccctacaagacagtgaagacatggtcggaagctgtccgttcgaacccgggcagaaacgcacggcaaggagagcaccgagcttcgagctgttccgattcctgagccggctagccaacctaaaactaacagtaggcagagccccagagcgacgactgacacccgatgaaatcgccttagcagcaaaagggttcggcgaaaccaagaaaagcataacattcaaatccctacgagaagcactagacctagaccccaacgccaggttcagtggggtagcaaaagaaaaagagtcaacactcgacgtcgcggcgcgtaccggcggcgctgcctacggcactaaaacactaaaggacgctctcggagacgcgccatggagatcgctgtcaaggatgccagaaaaactagaccgcatagcagaaattctttcgttccgagaggacatgaaagcaatacgcaacggcctcgaggaagtcggactcgatggcctagtggtagacgcgctaatgcaagcgaccgccaacggagacttcaaagacttcacccgagcggcacacatcagtgccctcgcggccagaaacataataccaggactgcgagaaggactggtgtacagcgacgcctgcaccagagtaggatacgaccacgcagcacgaccagcagtccccctaagccaaataggctcccccgtcacgcgaaaagccctctcggaggcgctaaaacaagtaagagcagtagcacgagaatacggaccaatagactactttcacatagaattagcacgaagcatcggcaaaagcgctgaggaaagaaagaaactcacggacggcatagaggcaaggaacgtggaaaaagaaaaacgaaggaaagaggcagctgaacacctcggaagggcacccagcgacgacgagttactcagatacgaactagccaaggaacaaaactttaagtgcatatacagcggagacccaatagacccagccgggataagcgcaaacgacacccgctaccaagtcgaccacatactgccatggagcagattcggcgacgacagctacgtaaacaaaaccctctgcacagcaagaagcaaccaaaacaaacgagggcgcaccccattcgaatggttcgacgccgacaaaacagaagccgaatggatggaatacagcgcaagagtggaggacctcaaggaggtcaaaggacggaagaaacgaaactacagcataaaagacgcagcaagcgtagaagacaaattcaaagccagaaacctcactgatacccaatgggcgactcgcctcctcgcagacgaactgaaacgcatgttcccgcccagagaatgcgagcgcgttgtaacagtacgcgcagatggcggcaacgatggcctaagcatagtagaagaaagacgcgtcttcaccagaccaggagcgattacaagcaaactccgccgagcatggggcctagagggactcaagaaacaagacggaaaacgagttgaagacgaccgacaccatgcggtcgacgctctagtattagcagcaacaacagagagcctactaaatagactcaccgtcgaggtacaacaacgtgaacgggaaggaagacaagatgacatattccactgtagccagccatggccgggattccgggtcgacgtacaaaggaccgtatacgggagcgaaaccatgcccggcatctttgtgagcagagcggaacgacgcagagcccgcggtaaagcacacgacgcaacagtgaaacaaatacgggacatagacggggaacggatagtgttcgaacgcaaacccatcgagaagctaacagacaaagacctcgagcgcatacccgtacccgaaccatacggaaaggccgccgaccccaagaaactacgagacgaactcgtagaaaacctacgagcatggatcgccgcgggcaaaccgaaagacaaaccgcccagatcccccaaaggagatatcataagaaaagtccggattgaaaccaaagacaaagtagcagtcgagatcaacggaggaaccgtcgataggggagatatggcaagagtagacgttttccgcaagaaaaacaagaaaggcgtgtgggagttctacgtaatacccatctacccgcaccaaatagtagcatcagccctaccgccaaaccgcgcggtcatagcctacaaagccgaatctgaatggaccgcgatcgacgggtgcttcgaatttgcatggagcctaaaccctatgagctatctcgaactcgtaaaatcaaacggtgagctcatagaaggatacttccgctcaatggaccgaacaaccggtgccatcaacctcagtcctatgagcacaaacagcgaaacaatacgcagcataggggtcaaaacgctgagcagcttcagaaaattcacagtagatcgcctgggcagaaaattcgagataccccgcgaagtccgaacctggagaggggaagcctgcacctga

SEQ ID NO: 7309 - RNA, 3195 nt, synthetic construct
  misc_feature 1..3195: note = Cas9 variant
  source 1..3195: mol_type = other RNA
atgaaaaggacaagcctccgagcatatcgcctcggagtcgaccttggagccaacagtctcggatggttcgtagtatggctcgacgaccatgggcaacccgaaggacttgggcccggtggcgtacgaatattcccggacggtaggaacccgcagagcaaacaaagcaacgccgcaggccgccgactagcccgctcagcccggcggagaagagacagatacctgcaaagacgaggaaaactaatgggactcctagtaaaacacggactaatgccggccgacgaacccgctcgaaagcgcctagaatgccttgacccatacggactaagagccaaagccctggacgaagtcctgccactccaccacgtaggcagagcactcttccatctaaaccaaagacggggactcttcgcaaatagagccatcgaacagggcgacaaagacgccagcgcgataaaggccgccgcaggacgcctacaaacatcaatgcaagcgtgcggagcaagaacactaggagagttcctgaacagacgccaccaactacgtgctacggtcagagcaagaagcccagtcggaggcgacgtacaagcaaggtacgagttctacccaacgcgcgcaatggtagacgcagagttcgaagcaatatgggccgcacaggcgccacaccacccgacaatgaccgcggaagcacacgacactatacgagaggcaatattcagccaaagagcaatgaagagaccgtctataggcaaatgctccctcgacccagcaacctcacaggacgacgtcgacggcttccgttgcgcatggtcccatccattggcacaaagattccgcatatggcaggacgtccgaaacctagccgtcgtcgagaccggccctacgtcaagtcgactagggaaagaagaccaagacaaggtagccagggctctcctacaaaccgaccagctcagcttcgacgaaattagaggcctgctgggactaccttccgacgctaggttcaacctagaaagcgaccgcagggaccacctgaagggagatgcaaccggggctatactctcagcacgcagacactttggacccgcctggcacgacagatccctcgaccgccaaatagacatcgtggcactactcgaaagcgcactcgacgaagccgcaatcatcgcatcgttaggcacaacgcactcactggacgaagcagccgcccaaagagcactaagcgcattactccccgacggctactgcagactgggactgagggcaataaaacgtgtcctaccccttatggaagctggaaggacctacgcagaagcagcatccgccgctggatacgaccacgcgctcctacccggaggcaaactatccccaaccggctatctaccctactacggccagtggctccagaacgacgtagtgggatctgacgacgaacgcgacaccaacgagcgacgatggggacgactcccaaacccaaccgtccacataggaatcggccaactgagacgggtcgtaaacgaactaatccggtggcacggcccaccagccgagatcacggtggaactgaccagggacctcaaactatcaccacgacgactcgccgaactagaaagagagcaagcagaaaaccaaagaaagaacgataaacgcacctccctcctgagaaaactaggcctacccgcatccactcacaacctactaaaactacgactatgggacgaacaaggagacgtcgcttccgagtgcccatatacaggagaagcaataggactcgagcgcctcgtatcagacgacgtcgacatagaccacttaatacccttctcaatctcatgggacgactcagctgccaataaagtggtgtgcatgcgatacgcgaacagagagaaaggcaacagaaccccctttgaagccttcggccaccggcaaggccgcccctacgactgggcagacatcgcagaacgcgcagcgcgactacctcgtggcaaaagatggcgattcggccccggagcaagagcccaatttgaagaactaggcgacttccaagcgcgtttactaaacgaaacctcatggctggcacgggtagcgaaacagtacctagcggccgtaacgcacccacaccgaatacacgtacttccaggacgcctcaccgccctgcttagagcaacatgggaactcaacgacctgctccctggctccgacgaccgggcagccaaatcaaggaaagatcaccgacaccacgccatagacgcgctagtagcagcactaacggaccaagcgctgttacggcgcatggccaacgcccacgacgacacccgccgaaaaatcgaagtactcctgccatggccgacgttccgcatcgacctcgagacaagactaaaggccatgctagtctcacataaaccagaccatggactacaagcaagactacacgaagacacagcatatggaacggtcgaacacccggaaacagaagacggcgccaacctcgtatatagaaaaacatttgtcgacatatcggagaaggagatcgatagaattagagacagaagactgcgggacctagtacgagcacacgtggcaggcgaacgtcagcagggtaaaacccttaaggcagctgtattatcattcgcccaacgaagagatatagccggccatccaaacggaatacgccacgtcagactaaccaaaagcatcaaaccagactacctcgtccccatacgagacaaagccggaaggatatacaaatcatacaatgcgggcgaaaacgcatttgtcgacatacttcaagccgaatcgggcagatggatcgcacgcgctaccacagtattccaagccaaccaggccaacgaatcacacgacgccccagctgcgcaaccaatcatgagagtatttaagggcgacatgctccgaatagaccacgcaggggcggaaaaatttgtaaagatcgtccggctatcacccagcaacaacctactatacctcgtggaacaccatcaggccggagtattccaaacaaggcacgacgacccagaagacagcttccgatggctctttgcgagcttcgataagctaagagaatggaacgccgaactcgtaagaatagacacactaggccagccctggcgaagaaagcgaggcctagaaaccggctcagaagacgcaacccgaatcggctggacccgcccaaagaaatggccatga

SEQ ID NO: 7310 - RNA, 3198 nt, synthetic construct
  misc_feature 1..3198: note = Cas9 variant
  source 1..3198: mol_type = other RNA
atgaataaggacatcaactacgccctgggcttagacatagggatcaccagcgtggggtgggccgtcatcaacctggatctgaaccgcatcgaggacctcggggtccggatatttaatgcggccgaaaacctgaaggacggctcaagcctagccctcccacgccggctggcccgcgggcggcgccggctgttgcgccggaaggcctaccgcgtggagcgagtccgcaagctcatactgaagaacaacatcctcaccaaggaggagctggagggcctgtttaagaacaaggaggtgatcgacgtgtgggaggcgagggtcaaaggcctcgactacaagctgtcccgcgaggagtgggccaagatcctcatcaacttctgcaagcggcgcgggttcaagagcaaccggaagaacgaggccaaagacaaggaagccggtcagatcctgtccagcatcagctacaatatcgagaagatgaaggagacgaacagccggacaatcggggagtacatctataacgaagtgaagaactccgaggacagctacgcgccgctgcggaacaagttcggcgagtacaagatgtgcgtttcccgcgacgtgatacgggaggagatccacacactgttcgagaagcagagggaactcgggaacaacttcgctagcgacgagatcgaggacaagtacttcgagatcttcaactcccagcgccccttcagcaacttcgaggacctggagaagctggtgggtttctgcaccttcgagagaaagaagcacaaacgcgcccccaagcactgcatctccagcgaggagttcacgctctacgagggcatcaacaagctgtccatcataaaggacggggagaagcggaagctgagcgaggaagaacgcaccctcgtggtcaacgaggccttcaataagaaggagataaaatacaccaccctgcggaagctcctcggcttatccgaggaggaactgttcagcacgctcacctacagcatcgacaaggacatctccaagaccgagaacaccaagttcgtgagcctgaaggggtaccacgagatcaagcgcgcgatcgagaagggggtgtccaagaaggcgtggcaggacatcgagaataaccggaacctgctcaacgacatcgcctacgtcctgacgctgggcaagaccgacgacgagatcgagaagcagctccgcctgcggaacgtgccagaggagctgttcgagagcctcctggacatgtccttcaacaagttcaacaacctgagcatctacgccttggagaagatcctgccgttcatgaaggaggggtatcagtacaacgaggcatgcgagaaggccggatacaacttcaaggcgatctacgagggggtgcgcaccaagaagctgcccgtcatcgagatcgacgagatcgtgaaccccgtggtcaaccgggccctcgcccagacccgcaaggtgatcaactccgtgatagacaagtacggcagccccgtcaggatcaacatcgagttggcccgcgacctggccaagaacttcaaggaccggaagctgatcgagaaggagcagaaggagaaccgcgcgaacctcgacaagatccgggagaacctgcgcgagctgatggacaaggaaccgacggtggtcgaggtcctcaagtaccggctgtgggagcagcagcgcggcgagtgcgcctacacccagtcccagatacccctggagcgcctcttcagccccggttactgcgagatcgaccatatcatccccttctcccggagcttcgacgactccctgagcaacaagattctggtgttaggctcagaaaaccagagaaaggggaatcggaccccttacgagtacttcggcgaggacagcgaacgctggaactcctttgagatctgggtcaaggggagctacctgaactacaagaaaaaggccaacctgctcaagaagaagttctccgaggaggagcagcgggactggaaggcccgcaacctgcaggacaccaagtacatctgccggtacatcagcaacttcgtgaacaaccgcctggagttcaaggagagcgaaaacaagcagaaggtcatcacggtcaacggccgggccaccgcgtacctccgctcgcggtgggggctgaacaaagtgcgcgaggacggcgacaagcaccacgccctggacgccgccgtggtcggcgtgaccacccaggggatggtgcagaagattagcaagtactccaaggcccacgagctctacacggtccggaagaacgacgagttcgtggacgtcgagaccggcgagtgcgtcgacgtggacgagtacaaggagatccgtaaggacatcctcccccggccttggcgcgggttcagcgaggagctgaagctccggctgtccgacaaccccctggaggagctcaagaagtccccgatcgagacctacaacgaggagttcatcaaggagaacgtgaagcccatcttcgtttcaagggtgcccttccggaagatcagcggcaaacttttcaaggagactatctacagcgagcgcgccttcaaggacggatacttcgtgagcaagaagtccttagttgacctcaagcggggcgacctggacaacttctacaactacgagtgcgacaagaagttatacgacgccatcagcgaacgcatgaaggagttcaactacaacggcaagaaggccttcgagtcccccttccgcaagccgaccaagagtgggaaagagggccccgtggtgcggtccgtaaagatcaagagcgccgtgcccttcaaggacgggatccccatgaacgagggcctcgtggcgaaggagggcatggtccgcatcgacatctacgagaaggaggggaagtacttcgtagtgccggtctaccggtaccaactggccaaaggcatcgtgcccaagcgcgccgccatcgccaagaaggacgagctgaagtggcccataatggaccagacctacaacttcaagttctccatctataagaacgacctcatagaggtcaaatacgacaagaagggggtctacttcggctactatgacgggttcgaccggaacagcgcgagcctgaccatcgagaagcacgacaactccgagcgctaccggtcaatcggcctgaaggtgggcgtgctcgagatcaacaagtacgaggtcgacgtactagggaactaccacaaggtgaaactgggcgggaactga

SEQ ID NO: 7311 - RNA, 3198 nt, synthetic construct
  misc_feature 1..3198: note = Cas9 variant
  source 1..3198: mol_type = other RNA
atgaacaaggacatcaactacgccctgggacttgacatcgggatcaccagcgttggctgggccgtcatcaatctggacctgaaccgcatcgaggacctcggggtacgaatcttcaacgcggccgagaaccccaaagacggctccagcctggccctgccgcgccggttagcccgcgggcggcgccggctgctgcgccggaaggcatacagggtggagcgggtccgcaagctcatcgtgaagaacaacatcctgaccaaagaggagctggagggcctattcaagaataaggaggtgatcgacgtttgggaggcgcgggtgaagggcctggactacaagctgagccgagaggagtgggccaagatcctcatcaacttttgtaagcggcgagggttcaagagcaaccggaagaacgagacgaaggacaaagaagccggtcagatcttatccagcatctcgtataacatcgagaagatgaaggagaccaacagccgtaccatcggggagtacatctacaatgaggtgaagaactccgacgacagctacgcgcccctgcggaacaagttcggcgaatacaagatgtgcgtgtcccgcgacgtgctccgggaggagatccataccctattcgagaagcagagagagctggggaacaacttcgccagcgacgagatcgaggacaagtacttcgagatcttcaactcccagcgccccttcagcaacttcgaggacttggagaagctggtgggcttctgcacgttcgagcgtaagaagcataagcgcgcccccaagcactgcatttcctcagaagagttcaccctgtacgagggcatcaacaagctctccatcatcaaggacggggagaaacggaagctgagcgaggaggagcgcaccctggtcgtcaacgaagccttcaacaagaaggagatcaagtacaccacgctccggaaactgctgggcctctccgaggacgagctgttcagcacactcacctacagcatcgacaaggacatctccaaaaccgagaacacgaagttcgtctcgctcaaggggtaccacgagattaagcgcgcgatcgagaagggcgtcagtaagaaggcatggcaggacatcgagaacaaccgcaatctgctgaacgacatcgcgtacgtgctcaccctgggcaagaccgatgacgagatcgagaagcagctgcgcctccggaacgtgccggaggagttgttcgagagcctgctcgacatgtccttcagcaagttcaacaacctctccatttacgccctggagaagatcctccccttcatgaaggaggggtaccagtacaacgaggcctgcgagaaggccggctacaacttcaaggccatctacgagggggtccgcaccaagaagctgcccgtgatcgagatcgacgagatcgtgaaccccgtcgtcaaccgggcgctggcccaaacgcgcaaggtgatcaacagcgtcatcgacaaatacggttcaccggtgcggatcaacatcgagctcgcccgcgacctggccaaaaacttcaaggaccggaagctgatcgagaaggagcagaaggagaaccgcgccaacctagacaagatccgcgagaacctccgcgaactgatggacaaggagcccaccgcggtcgaggtgctgaaataccggctctgggagcagcagcgcggggagtgtgcctacacccagagccagatcgccctggagcgcctgttctcccccggatactgcgagatcgaccacattatccccttcagccggtccttcgacgactcgctctccaacaagatcctggtgctgggcagcgagaaccagcgcaaggggaacaaaatcccgtacgagtacttcggcgaggactccgagcggtggaatagcttcgagatctgggtcaaggggtcctacctcaactacaagaagaaggccaacctgctaaagaagaagttcaccgaggaggagcagcgcgactggaaggcccggaacctccaggacacgaagtacatatgccgctacatcagcaactttgtgaacaaccggctggagttcaaagaaagcgagaacaagcagaaggtgatcacggtcaacggcagagcgaccgcctacctgcggtcccgatgggggctcaacaaggtgcgggaggacggggacaagcatcacgccctggacgccgcggtggtcggcgtgaccacacagggaatggtgcagaagatctcaaaatactccaaggcccacgagctgtataccgtacgcaagaacgacgagttcgtggacgtggagaccggcgagtgcgttgacgtggacgagtacaaggagattaggaaggacatcctcccccgcccctggcggggcttcagcgaggagctgaagctgcgcctctccgacaaccccctggaggagctgaagaagctcccgatcgagacctacaacgaggagttcataaaagagaacgtcaagccaatcttcgtctcgcgggtgcccttccgcaagatctccggtaagctgttcaaggagacgatctacagcgaacgggccttcaaggacgggtatttcgtgagcaagaagtccctggtcgacctcaagcgcggcgacctggacaacttctacaactacgagtgcgataagaagctgtacgacgccataagcgagcgtatgaaggagttcaactacaacggcaagaaggccttcgagagccccttccgcaagccgaccaagtccgggaaggagggtcccgtggtgcgcagcgtcaagatcaagtccgcggccccattcaaggatgggatccctatgaacgagggcctcgtggccaaggaaggcatggtgcggatcgacatctacgagaaggaggggaagtacttcgtcgtgccggtgtaccgctaccagctggccaagggcatcgtccccaagcgggccgcgatcgccggcaagagcgagctgaagtggcccatcatggaccagacctacaactttaagttctccatctttaagaacgatttaatcgagattaagtacgccaagaaggacgggtacttcgggtactacgacggcttcgaccgccacaccgcgagcctggtgatcgagaaccacgacaacagcgaccggtaccgcggcatcggggtgaagacgggcgtcgtcgagttcaacaagtacgaggtggacgtcctggggaactaccacaaggtgaacctcggcgggaattga

SEQ ID NO: 7312 - RNA, 3201 nt, synthetic construct
  misc_feature 1..3201: note = Cas9 variant
  source 1..3201: mol_type = other RNA
atgagtgagagggtagtgagaagaatcttagggatagaccttgggatagcaagctgcggatggggagtggtcgacatcagcggggcgggaggagggatcatcgccacgggagtacggtgcttcgacgcacccctgatagataaaaccggcgagccaaaaagcgcaaccagacgaacggcacggggccaaagacgtatagtacgaagacgccgacaacgaatgaacggggtaagaaggcttctatgcgagttcggccttctgcccgacccgaggccagatgcgctcaaccaagccatgcgaaggatatcaacagctagcgccgccgcgcaagtgacgccatggacactacgggccgccgcccatcagaggctgctgagcaacgaagaacttgccgtagtattagggcacatagcccgacaccggggattcagaagcaacgcgaaaaacgaagcgggagcgaacgcagccgacgaaacgagcaagatgaagaaggcaatggaagcaacacgcgaagggctagccaagtaccacgcattcggagatatgatagcaaatgaccctaagttcgcgaacagaaaaagaaacagagacaaagactactcacacacagccaagcgctcagacctagaggacgaagtaagagcaatactaagggcacagctaagattcggatcagcggcagccacggaaacgctagcacaaactttcgcagacgtcgcatttttccagcgaccgctacaagacagcgaagacagagtcggcgactgcccatttgagccagggcagaaaagagcagcaagaagggccccgtcgttcgagctgttcagattcctgtcgagactggccaacctgaaactcgcagtaggccgatcgccagaaagacggctcacagcagaagaaatagccctagccgccaaagggtttggcgagaccaagaaaaccattacctttaaatccctgcgcgaggccctagatctagacccaaacgcgagattcagcgggatcgggaaagacaaagaggccagcttagacgtcgtcgcacgaacaggaggagcggcatacggaacaaagaccctcaaagatgcactgggagacgcaccgtggaggtcattgagccgaacaccagaaacactagatagaatagcagaaatactcagcttcagagaagacataacaagtataaggaacggactagaagacctgggcttggactcgctggtagtagaggcgctaatgcaggcggcagccaacggcgacttcaaggagttcactcgagcagggcacataagcgcccgagcagcacgaaacataatcccggggctgcgagaagggctagtctacagcgaagcgtgcgcacgtgtgggctacgaccacgcggcgagactgagcgtaccgctcgatcaagtgggaagcccagttaccagaaaagcactgagcgaagcactcaaacaagtaagggcagtagcacgggaatacgggccgatcgattactttcatattgagctcgccaggtcggtaggaaaatcagccgaagaaagaaagcaactcacggacgggatagaagcgcgaaacgtggaaaaggcgaagcgaaggaagcaagccgaagaacacctcgggcgagcgccctcggacgacgaactactacggtacgaactcgccaaagagcagaatttcaaatgtatatactcaggggacgcgatcgacccggcaggggtagccgccaatgacacaagataccaagtggaccatatactgccatggagccgattcggagacgatagttatctgaacaaaacactttgcacagcgcgatccaaccaaaacaaacgcggacgaacacctttcgaatggttcgaagcggataaaacggacgtagaatggatggagtacgtggccagagtggagaatttgcaggaagtaaaaggccggaagaaaagaaactactcaataaaagacgcagcagccatagaagacaaattcaaagcgagaaacctgacagacacgcagtgggcaacgagactactagcggacgaactaagcagaatgtttccgccaagagagtgcgaacgagcgatctgcggtagagcagacggcggaaacgacggcctaacgatagtggaagaaaggagggtattcacgagaccgggcgcgataacgagcaaactaagacgagcctggggactggaaggcctgaagaaacaagacgggaaaagggtggaagacgacaggcaccacgcagtagacgccctagtcctagcagcaacgaccgaaagcctcctacagcgactgacagtcgaggtacaaagacgggagagggagggcaggcccgacgacatcttccactgcgcagagccgtggagaggctttcgggcggacgtaaggcgaacagtgtatggaagcgaaacaatgcctggcatattcgtatccagagcagaaaggaggcgcgccagaggaaaagcccacgacgcgaccataaaacaaatcagagaaatcgagggggaacggctagtattcgagagaaagccggtggaaaagctaacggacaaagacctagagaaaatcccaattccaaaaccatacggacaagtttcagacccaaaacggctacgagacgaattagtagaaagcctacgcgcatggatagcggcaggcaagccgaaagaccgaccgcccctaagtcccaaaggcgacgtaatccgcaaagtcaggatacagacaaacgataaggtttcagtggaaataaacgggggcacagtggaccggggcgacatggctcgagtcgacgtgttcagaaagaaaaacaagaaagcggtctgggaatactacgtagtaccgatatacccacatcaaatagtagcgctgaatgacccaccagacagggcggtaatagcctatgcagaagacaaagactggaaagaaatagacagtagctacgagttcctctggagtctctttggactaagctacgttgaaattagcaaagcaaacggcgaatgtatagacgggtacttcaggggcctccaccgagggacaggggcagcatccgtatgcaaacacatatcactgggcaaagacgcgacagtgtcggggatagggttaaaaacactagccagcttcaagaaattcacaatcgaccggctagggcgcaaattcgagataccacgggaggtaagaacgtggcgcggggaagcctgcacctga

SEQ ID NO: 7313 - RNA, 3201 nt, synthetic construct
  misc_feature 1..3201: note = Cas9 variant
  source 1..3201: mol_type = other RNA
atgtctcacttggtactaggcctcgatctcggccccaatagcataggatgggcgctagtcaacgatgacccagaacacccggtcgagagcaaactcgtagacctaggcgtccgagtattccccgaaggggtggacaacttcgacacgtcaaaggaactaagccgaaacgaagacagacgcgtagccagaggaatgagaagacaaatccgccggcgcgcaagacgaagacagcaattaaaacaagcgctaatagacagcaaactctggccatccgaccccaacgacgaagtggtcttatacaacaccaacccctacgaacttcgagcccgagccctgaaggagcgactcgaaccccacgaagttggccgagtcctgctccacctaaaccaaagaagaggattcctatcaaaccgaaagaaagaccgcggggacaaagaggtacaaggaatgctagccgaaataaacgaaaacgaacaacagtgcaaagatggaggcttcgatactatcggagcttggctagctgacaaacaggccaacatcgaccacgctaacagagaggaaaacgaccacgtgcggaaccgccacctagcacggtcacaatacgtggatgagttcgaagccatctggagcgtccaagccaaacaccatcccaaactgctaaccgaagaactaaaagtcggaaaactaggaaagcagacctatccagtaaaaccaatcccacggtggcacgaacaccgacaaggattgtcacccctagaatcattcggcatctatggcctaattttctttcaaagaccaatgtactggccgaaaagcgtcgtcggcctatgcgaactagaacccaaagaacgtcgatgccaacgctctgacaggagacaacaaaggtttagactgctacaggaggtaaacaacttgaaatatgtagacccggacacccatctcgaacaaaaacttgacgacaagcagcgacgccttctcttagacaaactatcgcacacaaaagagatgaccttcgaccaaatacgcaaagcactcgacttcttagagagtgtcaaattcaacctcgaacgaggagaacgatcacgactcaaaggcgtcccaatagacgcactgttcgcagcgaaggacgtacttggccaagagtggtacgacagacccgagcaacagaaaacagaaatagttgcggtcctcctggacaacgagcgagacgacgatcgaatcatcgcacgagcggtagcagaatgggggatgaccgccaaggaagccgaagccatgctcggggtggacctaccggcaggatacgccaacctgagctgcaaagccatcgaaaagctgctaccccacatggaaaggggcttactatacatggacgacgatgaaagcaacagcgcaatgcacgcagcaggatacctcagaagagaccaacttcgacgccgtatattcgacgtactcccggacccggcaaggacccccaattgccccataggagacatcccaaaccccgtcgtaaaacgcacgctcacagaaatccggaaagtagtcaatgccatagtccgcgaatacggcaagccagacgccatacacctagaactagcacgaagcgtacaaatggggaaggaaaagcgctccgaatacagcaaaatgatccgcgaccgcgaagccgaacgcgacgggatcgtcgaaaaactgagagagagcggagtacgagtcacacgcgacaacatactcaagtaccaactgtgggaacagcaaaatcaggaatgcatatactcaggcaaaccaattagctttgaaaagctattcggcgagggcggaggcgtagaagtggaccacatcctcccaagaagcagaagtctcgacgacagccaggcgaacaaaatagtatgcctccgtaccgctaacgcaggcaaaggggaccaaaccccctacgagtggctagcagatacacagccgaaacagtacgaacaagtctgccaacgagccgggatgctcatgagatcaggaagaatgccctacgccaaatatcgcaggttcatccagcgggaactggaactagacaagttcatcgcacgtcaactagccgacaccggatacattacaaaagccaccatggaatacctacgatacctattcgacaaagaccacgacgtactaggcctaaagggacaacttacggccgagctacgataccattggggcctagagaccatcctagaagaactacccgacagcccagcatggcacgaagcagactcaggaaaactccgaccaggtgagaaaaaccgtgctgaccaccgccatcacgcaatagacgccgtggtcatcgcgctaaccaaccgaaggcgcctggtccagctctccgacattgtaaagcgcggcggcgcccgagcacacggagaaattctagaagacccatggccaaactttcgcgaaaacgtggtacaagcaatcaagaaaaccaacgtatcacaccgagtagaacgaaaagtcgcgggcaaactacacgaggaaacgctatacgggccaacgagaacaccaggggaatgggtcctaagaaaacccgtcattgcactctccgcaaacgaagtagaacgaatccgggacgcaaccatcagacaaatcgtggttagcgcccttgcggacgccgggatcgacgtaggccggggcaaaaagcccgacgccaaaaagatgaaggaggcattaagcaaactaaaaatgccaagcggagttcccataagaaaagtacgactaaccaaacccgaacaaacgatccaacccgtgcgagccggacgaccggaccaggcattcgtaaaacccggatccacacaccacctgtgcatattcgagttcacggaaaacggaaaaacaaaacgggacgccgtattcgtgaccatgctagaagcgatgaacagactaaaacgccgggaaccggtaatccaacggacacacccggaacggccagactcccgcttcgtcatgagcctatcggcccgagaaatgctgctagcgaactggaaagacggcgaacgactcctaaccttcaagaccgccagcagtacgcaaggacaaatatggttcgcagagcacaccgacgccagaaaatcagccgactacaaacagtttgtagcgaacgcgaataccttagacgctaagaaagtcacagtagacccgctcggtcgtatacgatgggccaatgactga

SEQ ID NO: 7314 - RNA, 3204 nt, synthetic construct
  misc_feature 1..3204: note = Cas9 variant
  source 1..3204: mol_type = other RNA
atgggaacacgattaggcttagatatcggaacaaactcaatcggatggtgcctattcaacctcgacggatccggccgacccataggcatacgagacataggagtcagaatcttcagcgacggacgggacccccgcagcggcgcgtctttagcagtcgagcgacgggtggcccgcgctatgcgacgacggagagacaggtatatcagacgccgcagcgccctcctagaagccctcataaatacagggctcatgccggcagacgtgcaggagagcaaggcgctaacaggatgcgatccatatgtccttcgcgcccaagcactagaccgggccttagacgcgcatctgctaggcagagttctcttccacttaaaccaacgacgcggattcaagtccaaccgaaaggcggaaagaaaagccggagacgacaaagaaggaggaaaaatagcagatggagcaaaagctctagacttagccatgcacgaagccggtgcccgaacatacggcgagttcctagctggccgagactcacgccgagtccgattacgcgcagaaggagacggatacgacttctacccagaacgccgacacctcgaagccgagttcgacgccatctgggacgcccaagccgcttacaatcccgcacttctcacggacgtcgtccgggatcgcctcaggcgcatcatcttcttccaacgaccactcaaagccccgaaggtaggaggatgcacattcttcaacgaggagccaaggctcccaaaggcccacccactttttcaagaacggcgcctgtacgaagaagtcaaccagctcgaaataacgcgggcaggcgcacccagtcggaaactaacactcgaccaacgagacaaaattataagaaaactaaaaagcgcaaagacggcgagcttctcaggcctagcaagattactgaaactagcggacggagaatcattctccagggtaacggaaaacagaacaggcctcgccggggacgacatcttcacaagtttcagcgacaagcgctgcttcggagaccgctgggcacacttcgacccaggcgtacaatggtcgataatcgaaactgtaacagaagaagaagacccggtgaggctacgagattggctaatggcgacccacggcgtcaccgtagagcaggcagaagcaattggaagagtaagactacccgagggacacggacgcctcggcgaaacagcaagccgcctcatcctagcacaactaaaaagcgggagcaaagacggacaccccctaacctacaacgaggccgtagaagcagcactaggcaagagtcacagcgacttccgcacaggagagatcctagaacaactaccatactatggagagatactttctcgagaaatcccaccaggatcactagacccagacgacgacgacgaaatacggtggggaaaaatcacgaaccccaccgtccacatcggcttaaaccaactcagacgactactaaacgccctaataaaagctcacggacgcccagacgaaattgtagtcgaactagcccgggaactaaaactctctgagaaagacaaagcggaacacaacagacgcatcggagccaacacacgcgctgcagaagcacgatcgaaaaagctcctcgaaagcggccaaccagacacaggggctaaccgctcactcctcaaactatgggaagacctcaacccaaataacccactggaccgctgctgcccattctgcggccgacacatcggacaaatggccctcttctcaggagagacagaaatagaacacataataccatactcacgctcactcgatgattcagccgctaacaaagttatcgcacatcgctcttgcaacagagagaaaggaaaccgcaccccatgggaagcctggggccacacagaacgatgggccataatcgcagaacaagtttcacgactccataaaagcaagcaatggagattcgccccagatgcaatagagagatttaaccaagaaggcgggtttatagcaagacagctctccgatactcaatacctaagcaggatggcccgaacctacctaagtagcctctacccggacaccgccggcgtatacgtcatacccggccgcatgacagccatgctacgcagactctggggcctcaacgaactactacccgaccacaactacgtagaaaatccacattcgggtgcacccaagaaccgactcgatcacagacaccacgcgatagacgccgcagtagtaggagtaaccacgcgagggctactcaacgagatcagtcgagcagcagggcgagccgaaagacaggacctggaccgcctgttcattgacctcccaaagccgtgggaaaccttcagagaggacctacacgagagcctcgccagagtggtaggaagccacaaagcagaccacggcagaaaaggagtacccgcaaaaggaaaagacgcaacagccgcacgcctccacaatgagacagcatatggactaacgggactcacaagtgaatcagggttaccaatagtagtccaccgcgtccctctcctaagcctgaaaccggacgacctgagcaacccgatacgcatcccagacgcagccctccaacgagccctgagagaagcgactgacggaaaaagcggaaaggacttccaagaggcgctagcccaattctcaaaatcagacccggtattcaaagggatccgtcacgtacgggtgcgagaaacattaaaggtgataccaattagagacgcgagcggacacgcattcaaagcctacaaaggcgacgcaaacgccagatacgacgtatggcgaatgccagacggcaaatgggtcagcagctggcgagacagagatgggaaagcccacagcggaataatcacgatgttcgcggctcaccaagccggacaacccgtgcaacgtccacacccagccgcaaaacgcgtactctcgctcagacaaaacgacctagtagcagtcgaacctcaaggacagccgcgaaagataatgcgagtcgtaaagttcagctccggaggccaaataaccttcgccgaacatcaggaagcaggccccctgaaagccagggacgcgacgtcgcccgacatagaccctttcaaatatttttacagctccgcaggaggcctgcaaaaagcccgagcgagacagatccgaatcgatgagctcggccgcatcttcgatcctggaccaagatga

SEQ ID NO: 7315 - RNA, 3207 nt, synthetic construct
  misc_feature 1..3207: note = Cas9 variant
  source 1..3207: mol_type = other RNA
atgaagtacgtgctgggcctcgacatcgggatcgccagctgcggctgggccgtcatcaatcaggagaagcaccgcatcgaggacctgggggtgcggatcttcgataaggcagagaacccgaaggacggcaagtccctggccaccccgcgccgggacgcccgcagcacccggcgcacgctccggcgcaagaagcaccggatgcagcgcatcaaaatcctgctggtgaagcacgggctcctgtccaagaccgagatcgaccacctgtacgagagcgccaccgagatcgacgtctggtacctccggctgaacgccctggagcgccggctcaaccccaaagagttcgcgcgcgtgctgatccatctgtccaagcggcgcggcttcaagagcaaccggaaggagaccacgctatccgagaacggccagatcctggagaacatcagcgagaacctgcagatcatggagcagaagaactaccgcaccgtgggggagatgatcctcaaggacaagcggttcgagaaccacaagcgcaacaaggacggcacctacatcggaaccgtcacgcggcaacagctgcaggaggagatccagatgatcttcaacgcccagagactgtacaagaacaaccacgccaccgagaagttcgagtccagctacctcgagatctgggcctcccagcggccctacgcgagcaaggaccagatcgagaagatgatcggctactgcaccctggagcccaaggagaagcgggtgccgaaggcctcctggagcttccagtacttcgtggccctgcagaccatcaacaacctccgcctgatctccaaggacagaatcgaggagttgagcttcgaggagaagaagcgaatcatgaacctcgccctggagaagtccatcgtcaagtacatcgatatccggaagctgctctctgtgcccaaggagttccagttcaactccctgagctacagcgccgacatcgtggacacgaccgtcgagaacaagaagtgcatcgagttaaaggagtaccactccatcaacaaggtgtacaagcagatctacgggcagaacgcgctcaacctgctgcccaaggactacgacaccatcgcctacggcctcaccatcttcaaggacgacaaggacatccaggaatacctgcagaacaagtacgtgaacgccaagggcaagcccatcagcaacctggccaacaagacgtacgacgacaccttcatccaggtcctcctgaccctgaacttctccaagatgggacacctcagcttcaaggccctgaagaacatcatcccgttcctggaggagggcctctcctacgacaaggcgtgcgagaaggccgggtacaacttcaagggcaccagctacacgaagaagaccaagtacctgcccgtgatcccccagaacaccaaccccgtggtccaccgcgcactgtcccagacccggaaggtgattaacgctatcatcaaaaagtacggcagtccgaacgccatccacatcgagacagcgcgcgagctctccaagaccttccaggagcggaaggagattgacagcatgtaccaggacaactccaagaagaacgagcacgccatctgcaagctgaaggagctggggaacatcaaccctagcggcatcaacatcgtgaagttcaagttatggaacgagcaggacgggcgctgcatgtacaccggcaagtacatcgagccccaccgcctcttcgaggaggggtacaccgaggtcgaccacatcctgccctacagccggagcctggatgactcctacaacaacaaggtgctcacgctgggcaccgaaaaccagcggaagggcaacaagaccccgtacgagtacatgcgcaacaacagcatctgggacgagttcgagacccgggtgcagtccaataagaagatcaacaagaagaagcagcagaagctgctcctgcagaacttcagccacgcacgcgagcaggagttcatcgagcgaaacctgaacgacacgcgctacgccaccatctacctctccagcctgatccagcagcatctgatcttcagtgagtccagccgggagaagaaggtccacaccgtgtccgggatcatcaccagccacctccgctccagatggggcttcaacaaggaccggaaggaggggcacatccaccacgccctggacgcggttatcgtggccgtgacaagcgaccatatgatccagcgcgtcaccaaatactataagctgaaggagctcaaccggaaccgccaggccaagcggatgcagttccccgagccgtgggagggcttccgcctggaactggaggcccggatctcccccaacacccagcagtacctcaaggggatccgcttcaagaactacgcggacgtgaacctgagcgagatcaagcccattttcgtgtcccggatgcccaagcgcagcatcaccggcgagcttcaccaggagaccatccggaagttcctcggctacaacgagaagggaaaggtcctgacggccaccaaaaccaaactggaggacatccccttcgacgccaacggcgactttcccatgttcgggaaggagaccgacctctacacgtacaacgccatcaaggagcgctacctgagtcacaagaaggacaagagcaagtccttccaggagccgctgtacaagcccaccaaaagcggcgggatcggccccctcattaagagcattaagatcatggacacccggaccatcgtgaaccctgtgaaccagggcaagggggtcgtgtacaacagcaagatcgcccgcacggacgtgttcaaaaagggcgagaagtactacctgatcccgatctacacaatcgacctgatgaagaacaccctcccccagaaggcgatcaccgccgggaagggctacgaggactggacgaccatcgacccctccttcaccttcctgttcagcctgtttccgaacgacctcatccagatcgtccccagcaagaacaagaccatcaaggcccggacgaccgtgtccaaaaaggaggtgctgctgcccagcctcaccggctacttcaagggggtccactccggcaccgccgggatcacggtggagacccacgacggcagcatcatcgccaacgtggggtccaagcagctgctaagtttcgagaagtaccaggtcgacgtgctcggccactacaccaagatcaagaaggagaaacgcatcggcatggcgatctga

SEQ ID NO: 7316 - RNA, 3207 nt, synthetic construct
  misc_feature 1..3207: note = Cas9 variant
  source 1..3207: mol_type = other RNA
atgaacaaagcagtcgcctacaggctagccctagacctcggatcaaccagcctcggctgggcaatcttcagactcaatgaagcccgggaaccaacggcgataatccgagcaggggtgcgaatcttctcagacggcagaaacgccaacagcgagccactagccgttcaccgacgcgtagcacgggcaatgaggagacgaagagaccgcctacttaaaaggaagaaacgcatgcacgaccaactggtccaacacggattcttcccagcagaagtagcagaacgcaaagaactagagcgtctgaacccataccaattgcgcgcaaaaggactacacgaagcgctgacgccaggggagttcgcaagagccctattccacataaatcaaaggcgcggcttcaaaagcaatcgtaagacagaccgaaaagacaatgacagcggggcactcaaacaagcgataagtgaactcagaaaaagaatacaagattccgactgcgcaacagcaggcgaatggttctggaaggaaagaatgcagcaaaaacccgaaggagtgcgcggacaatgggtacgagcgcggtacagaaaaacgcccagcaccacagacgaagggaagaaaaggatcgggtacgacttatacgtagatcgtgccatggtagaacaagagttcgacgccctctgggcggcgcaagcagcgttacaacccggtctattcaccgaagcggcaagagccgaactaaaagacacactcctctaccaacgagacctcaggccagtaaaacccgggaggtgcacgctcttaccagcggaagaaagagctcccctagcattaccctccacgcaacgcttcagaatcctacaagaggtgaacaacctccgactgctagacgaagccctacgcgaagtaccactaaatctcgcgcaaagagacgccgtcgtgagcgcactcgaaggaaagaaagaactcagcttcgcggccatacgtaaactattgaccctttcaggcaaattcaacctagaagatgaaaaacgcgctgaactaaaaggaaacgcaacaagtgtcatcctcgcacggaaagacctattcggagacgcgtgggcaggattcgatgcagccgtacaagacgaaatagtctggcgtctagtcagccaagagtcagagggcgcgctcatagcctggctacaacagcacacaggcgtcgacggcgtgtgcgccgaagcaatagtaaacacccgcctgcccgatggctacggaagactaagccgcaaagcactggaaagaatcgtcccggcactacagagagaagtatgcacatacgacaaggcagtgcaggcggcaggcttcgcccaccattcggacctagggttcgacttcgactacgcagaagacgaggtacaacaagtaggggaacatacaatagcctccaccggggaggtgcaggcgcaatacgctttcaagcaactcccatactacggaaaagcactacaacgtcacgtagcattcggcagcggcgacgccaaagatcacgaagaaaaatgttatggcaaaatcgcaaacccaacagtccacataggcctaaaccaagtaagaacggtggtaaacgctctaatccgccgctacggacacccgaccgaagtagtagtagaactcgcccgagacctcaagcaatcacgcgagcaaaaacagcagacccaaagggagcaagcggacaaccagaagcgcaatgaagacatacggaaacggatagcaccaatcctcgagaccagccctgaacgagtcagagaccgagatatcaaaaagtggatcctctgggaggagctaaacaagaaggacatagcggaccgacactgcccctatagtggcgaacggatctcagcaacaatgttactcagtgaagcagtggaaatagaacacatcctcccgttcagcagaacattagacgactcactcaacaaccggacagtcgcaatgagacgagcaaaccgaatcaaaggagaccgaacaccatgggaggccagggccgacttcgaagcacagggatggaggtacgaagcaatcctacaaagggcagagggcatgccgcccaggaaacgatacagattcgccgaagatgggtatcaacgctggctcggaaaagaccggaactttctagcgcgagcgctaaacgatacgtcttacctatcccgactagcagctaattacctccgattagtgtgcccccagggagtacgagtgatacccggacagatgacagataaactaaggggcaaattcggactcaactcagtactcggcttagacggcaagaaaaaccgaaacgaccaccggcaccacgcagtcgacgcttgtgtaataggcgtgacagatcaaggcctcatgcaacggttcgccaacgcgagcaaacaagcccgagaaaacggactaaccagactggtacaagatatgctgctgccctggtggccgtcctactacgaccacgtagaacgcgcagtccgccacatccgagtatcgcacagacccgaccacggcttcgagggagccatgatgaagggaacggcgcacggcataagagaagacggaatccgcgaggacggacgcataaaacaacgcccgaaagccaagggctccgcggaccacaaaaccataacactcataccaatagatgaaccccgccaactcgcacgccacggggtagacgccgagggaaaacccctcccatacaagggatacgcatccggaagcaactactgcatagagattaccaaaaacggaaagggaaaatgggaaggacaagtaataagcacattcgacgcctacagaataaaagcggcagcagacgcagccgcacgagcaggccaggtgattagcacagtagaagccgacagcatagttcgaaagtcagggtgggaaagactccggggcgcacaaagccaaaacggccagcccctggtaatgcgactcgttataggcgattcagtccggatggaagtggacgggagagacgaggttatgagagtagtaaaaatgtccggcaaggagatggtattcgcccccgtaagagaagccaatgtagacaaacgaaataatatgccggacgaacaggacccattcacctatacttacaaacgggcagaccagctcaggaaagcaaaagcaagacaagtaaccatcagcccaattggagaactaagggaccccgggttcaaagggtga

SEQ ID NO: 7317 - RNA, 3207 nt, synthetic construct
  misc_feature 1..3207: note = Cas9 variant
  source 1..3207: mol_type = other RNA
atgcagtacgtgctgggcctcgacattgggatcgccagctgcggctgggccgtcataaaccaggagaaggagcgtatcgaagatctgggggtgcggatcttcgacaaggcggagaaccccaaggacggcaagtccctggccgccccgcgccgggacgcccgcagcacccggcgcaccctccggcgcaagaagcaccggatgctgcgcatcaagatcctgctcgtgaaacaggggctgctgtccaagaacgagctcaaccacctgtacgagagcacgactgaggtcgacgtgtggaacctgcggctcgacgccctggagcgcaagctgaaccccaaggagttcacccgggtgctcatccacctggcgaagcgccggggcttcaagtccaaccgcaaggagaccacgctgagcgagaacggtcagatcctcgagtccatcagcgagaaccagcagatcatggagcagcagaattaccggaccgtcggggagatgatcctgaaggacaagaagttcgagaaccacaagcgcaacaaggacggcacctacatcgggaccgtgacgcgacagcagctacaggaggagatccagatgatcttcaccgcccagcgcctctacaagaacgactacgccaccgaggagttcgaaatctcctacctggagatctgggccagccagcggccctacgcgtccaaggaccagatcgagaagatgatcggctactgcaccctggagcccaaggagaagcgcgtgccgaaggccagctggtcattccagtacttcgtcgccctccagacaatcaacaacctgcgactgatcagcaaggaccggatcgaggagctctccttcaaggagaagaagcagatcatgaacctggccttagagaagtccatcgtgaagtacatcgacatccgcaagctcctgagcatccccaacgagttccagttcaacagcctgtcctacagcgccgacacagtggacaccaccctcgaaaacaagcggtgcattgagctgaaggagtactacagcatcaacaaggtctacaagcagatctacgagaagaacgcgctgaatctcctgcccatcgactacgacacaatcgcctacgggctgaccatcttcaaggacgacaaggacatcctcgagtacctgcagaacaagtacgtgaacgccaagggcaagcccataaacaacctggccaagaagacctacgactacacgttcatccaggccctcctgacgctgaacttcaccaagatgggccacctctccttcaaggcgcttaagaacatcatcccgttcctggaggaaggcctcagctacgacaaggcctgcgagaaggccggttacaacttcaaggggacctcctacaccgagaagacgaagtacctgcccgtgatcccccagaacaccaaccccgtcgtgcaccgcgccctgagccaaacccggaaggtgatcaacgccatcatcaagaagtacggctccccgaacgcgatccacatcgagactgcccgcgagctgagcaagacgttccaggagcggaaggagatcgactccatgtaccaggacaacagcaagaagaacgaacacgccatccacaagctcaaggagctgggcaacatcaacccctccgggatcaacatcgtcaagttcaagctgtggaacgaacaggacggccgctgcatgtacagcgggaagtatatcgagccccaccgcctcttcgaggagggctacaccgaggtggaccacatcctgccctactcccggagcctggacgactcctacaacaacaagaccctcaccctggggacggagaaccagcggaagggcaacaagaccccgtacgagtacatgggcaacaccagcatctggaacgacttcgagacccgcgtgcactccaacaagaagatcaacaagaagaagcagcagaagctgctcctgcagcacttcagctatgcccgggagcaagagttcatcgaacgcaacctgaacgacacgcggtacgccaccatctacctctccagcctgatccagcagcacctgatcttctccgagagcagccgcaagaagaaggtccacaccgtatccgggatcatcaccagccacctacggtcccgctggggcttcaacaaggaccggaaggaggggcacatccaccacgcgctggacgccgtgatcgtggccgtgaccagcgatcacatgatacagcgcgtaacgaagtactacaaactgaaggagctcaaccgcaacctgcaagccaagcggatgcccttccccgagccctgggagggcttccgcctggagctcgaggcgcggatctccccgaacacccagcagtacctgaaggggttccgcttcaaaaactacgccgacgtgaacctgagcgagatcaagccgatcttcgtgtcccggatgcccaagcgcagcatcaccggcgagctccaccaggagaccatccggaagttcatcggctacaacgagaaggggaaggtcctgacggccatcaagaccaagctggaagacatccccttcgacgccaacggcgacttcccgatgtacgggaaggagaccgacctctacacctacaacgccatcaaggagcgcttcctgtcccacaagaaggacaagcgcaagagcttccaggagcccctgtacaagcccacgaagtccggcgggatcggccccttaatcaagagcatcaagatcatcgacacccggaccatagtgaacccggtgaaccagggcaagggggtggtgtacaactcgaagatcgcgcggaccgacgtgttcaagaaggacgagaagtactacctaatccccatctacacgatcgacctgatgaagaacatcctcccccagaaggccatcaccgccggcaaggggtacgaggactggaccacaatcgacccgagcttcacgttcctgttctccctgttccccaacgacctcatccagatagtacccagcaagaacaagaccatcaaagcccgcaccaccgtgtccaagaaggaggtgctgctgcctagcctcacgggctacttcaagggcgtccacagcgggaccgccggcatcaccgtggagacccacgacgggtctgtgatcgcgaacgtcggcagcaaacagctgctgctcatcgaaaagtaccaggtggacatcctggggcactacacgaagatcaaggaggagaagcggatcggcatggccatctga

SEQ ID NO: 7318 - RNA, 3207 nt, synthetic construct
  misc_feature 1..3207: note = Cas9 variant
  source 1..3207: mol_type = other RNA
atgccaaagtccgccaaaccccaacaagcatacaccctaggcctcgacatcggaatagccagcgtaggcgcagccctactcggacaacaacacatcattggcctccacgtccgaaccttcgaccgcgcagaaacagccaaggaaggcgaaccgctaaataaaataaggcgtgacgcacgcctcacaagaagacgactacaacgaagggcacatcgactcttaagactaagaagattattcaaacgccacaacctcatacccgacacggacacctctacattcatatcaggccagtcgccctgggaacttcgcgcacaaggactcgaccgccaactcacaagcgcagagtggaccactgtactatatcacattgtcaaacacagagggttccacagcaaccgcaaaagcgaagtcaaaaccgacgaaaaagccggacagatgctcagcggtgtaaaccaaaaccaagccctgctcaaacaatccggactccgcacaatgggcgaattagccgcccgacatgaggcattccgcgaagctaagcgaaataagaagggcgcttacaatcacacattcagccgccacgatctagaggacgagctacacctcctcttctcccgccaacgcgaactcggcaacccttatgcaaccccagaactagaagatgcagtacacacactgttaatgcagcgccgccctgcactctcagggacaaacctcctgaaaatggtcggacactgcacattggaacccgacgagttccgagcaccaaaggcgtcctacactgctgaacgatttatatggcttactaagctaaacaacctacgcgtctcgggctctggcgaaactaggcccctaaacgaaagcgaacggcaagccctactcagcaagccgttctctcaatccaaactgacctacaaacaggtgcgaaagatcctagagctacccgacaacatccgattcgtagggctccattaccacccagcccaagacaacggaaaatccccagaaaacagagtatttttcgaagctaaagcatttcacgccctgcgcaacgtctacaagaaagccggtctgaacctcgagtggcaacgagacagccaaaaccccgaaaaactcgacaacatcacatacgcactaacggtattcaaagaagacaaagaagcgaagcagtggcttatagaaaagggagtagaagcaagcgtaatagaagccgtcctcaacgaatcattcagtgagttcgtccgcctctcgattaaagcactccgcaaaattatcccacacatggaaataggccacagatacgacgaagcagtgaaactcgccggatacagccatcattcacacctcccacaaccctccaaaacaccctacataccccgtttttccaaacaatccatagccaatccggtcgtcagtcgcgcactaaaccaagcccgtaagctcgtgaacgcaatagttagggagtatggacccccggacgccgtacacattgagctcgcacgtgacctaaacaaacccttcgacgaacgacggaagatagaaaaagaccaagaaaagtaccaaaaagacaaagcccgagacatagaaacatttcaagaaaacttcggcttcaccccgaaggggctacaacttacaaaatggagactataccgagaacagtcagggaaatgtgcctacagccttaaacccctcgacatcaatcgactattcgaagacggctacgtggaaatcgaccacgcccttccgtacagccgctcctttaatgacggcatgaacaacaaagtattaacactaacaacggaaaaccgcaacaaaggcaatcaaacaccgtacgaatacctcgacggcgccagcaactcagcacagtggcgcaacttcgtagcatgggtcaacagcaacaaatcttaccgcgcctcaaaacagagaaacctactccgaaaagactttgccgcccaagcagcaactgagttcagagaacgccacctcaccgacaccagatacatcgcgagagagttcaaacgcatggtagaaacacacctcaaactcaacaaaccaaaccaaaggtgcgtagtagtgagcggccaactaacagcttacctacgagcccgatggggactaatcaaagtccgagaaaacggggacctgcaccacgccctagacgcggccgtcgtagccgcatgctcccacgccatggtcaaacgtttagccgactacagccgccgcggagaactacaatacgcacgaggacaccacttcgaccccgaaaccggcgaaataatcgacatcaacgccctgcgcaaactagacgaccacttcccacaaccatggacggacttccgtcgagaactactcgcttggttgagcccagaccccgcacaacaattgaaaaacctagcatactacaccgacgaacggcttaaacaagtaaaacctatccgcgtcagcagagcccccacccgacgtgggctgggcgcagcacaccaggaaactataagatcagccaagtacctcggcgaaaaccgatccaccgtaaagacgcccctcgaaaaactcaaactaaaggacatacccaacatagtcggctacgaagacccacggaatcaccaactaatccaagcgatatcccaaagactcaccgaacacggtgacgacggcaaaaaggcattcaaagaacccctatacaagccgggaaataacaaaagcaccgcacccgtcgtacgctcagtgaaactattcacagtccaaaagagcggaatcccagtgcgaggaggaatcgccaacaacggaaatatggtaagagtcgacattttcaccaagaaagaacgatacttcgccgtccccgtatacgtctcggatgccgcccgaaacgaactaccaaacaaagccgtagccagaggaaaagacgggtggatagacatcgacgactccttctcctttctattcagcctctaccccaacgattgggtcagcgtagtggtgaaaccccacgaagccccatgcgaaggatactacgcgggtctcgacatttcgaccggagcaatccacatctgggcgcatgatagaaacagatccgtcggcaagaacgggctcatgcgctccatcgggataaaaactgcccactcggtcgagaaatatcacgtagatctgctagggaacctctacagagtcgttcatgagaccagaaaacctctgcgggcaggcaaatga

SEQ ID NO: 7319 - RNA, 3207 nt, synthetic construct
  misc_feature 1..3207: note = Cas9 variant
  source 1..3207: mol_type = other RNA
atgcagtatgtgctgggcctcgacatcgggatcgccagctgcggctgggccgtcataaaccaggagaaggagcgcatcgaggacctgggggtgcggatcttcgacaaggcggagaaccccaaagacggcaagtccatggccaccccgcgccgggacgcccgcagcacccggcgcacgctgcggcgcaagaagcaccggatgcagcgcatcaagatcatcctcgtgaaacaggggctcctgtccaagacagagctcgaccacctgtacgaaagcgccaccgaggtcgacgtgtggaacctgaggctcgacgccctggagcgcaagttgaaccccaaggagttcacccgggtgctcatccacctggcgaagcgccggggcttcaagtccaaccgcaaggagacgacgctgagcgagaacggccagatcctcgagtccatcagcgagaaccagcagatcatggggcagaagaactaccggaccgtcggcgagatgatcctgcaggacaagaagttcgagtcccacaagcgcaacaaggacgggacctacatcggcacggtgacccggcagcagctgcaggacgagatccagatgatcttcaacgcccagcgcctctacaagaacaactacgccaccgccgagttcgagaacagctacctggagatctgggcgtcccagcggccctacgcaagcaaggaccagatcgaaaagatgatcgggtactgcaccctggagcagaaggagaagcgcgcccccaaggcctcctggagcttccagtacttcgtggccctccagacgatcaacaacctgcgcctgatctccaaggacaggatcgaggagctcagcttcgaggaaaagaagcagatcatgaacctggcgctggagaagtccatcgtcaagtacatcgacatccgcaagctcctgagcgtgccgaacgagttccagttcaactctctgagctacagcgccgacaccgttgacatcaccgtcgagtcccgtaagtgcatcgagcttaaggagtaccacagcatcaacaaggtgtacaagcagatctacgaaaagaacgccttgaacctgctccccaaggactacgacaccatcgcctacggcctgacgatcttcaaggacgacaaggacatcctggagtacctccagaacaagtatgtgaatgccaagggcaagcccatctctaacttcgcgaacaagacctacgacgacacctttatccaggccctgctgaacctcaacttcaccaagatggggcacctgagcttcaaggccctgaagaacataatccccttcttagaggagggcctgtcctacgacaaggcctgcgagaaggccgggtacaacttcaagggcacgagctacaccgagaagaccaagtacctgccggtcatcccccaaaacaccaaccccgtggtgcaccgcgcgctcagccagacgcggaaggtcatcaacgccatcatcaagaagtacggcagccccaacgccatccacatcgagaccgcccgggagctgtccaagacattccaggagcggaaggagatcgacagcatgtaccaggacaactccaaaaagaacgagcacgccatctgcaagctgaaggagctcgggaacatcaacccgagcggcatcaacatcgtgaagttcaagctgtggaacgagcaggacgggcgctgcatgtactccggcaagtacatcgagccccaccgtctgttcgaggaggggtacaccgaggtggaccacatcctgccctacagccgctccctcgacgacagctacaacaacaagacgctcaccctgggcaccgagaaccagcggaaagggaacaagaccccctatgagtacatggggaacacgtccatctggaacgacttcgaaacccgcgtccagagcaacaagaagatcaccaagaagaagcagcagaagctcctgctgcagcacttctcctacgcgcgggagcaggagttcatcgagcgcaacctcaacgacacccggtacgccaccatctacctgagcagcctgatccagcagcacctcatcttctccgagagctcccgcaagaagaaggtgcacaccgtgtcgggcatcatcaccagtcacctccggagccggtggggattcaacaaggaccggaaggagggccacatccaccacgccctggacgcggtcatcgtggcggtcacctccgaccacatgattcagcgcgtgaccaagtactacaagctaaaggagctgaaccgcaacctgcaggccaagcggatgccgttccccgagccctgggaggggttccgcctcgagctggaggcccggatcagccccaacacgcagcagtatctgaaaggcttccgcttcaagaactacgccgacgtgaacctctccgagatcaagccgatcttcgtcagccggatgcccaagcgctccatcaccggcgagctgcaccaggagaccatccggaagttcatcgggtacaacgagaagggcaaggtgctgaccgccatcaagaccaagctcgaagacatccccttcgacgcgaacggggatttccccatgtacggcaaggagaccgacctgtacacctacaacgccatcaaggagcgcttcctgagccacaagaaggacaagcggaagtccttccaggagccgctctacaagcccaccaagagcgggggcatcggccccctgatcaagtccatcaagatcatcgacacgcgcaccatcgtgaaccccgtcaaccaggggaagggcgtggtgtacaacagcaagatcgcccggaccgacgtcttcaagaaggacgagaagtactacctcatcccgatctacaccatcgacctcatgaagaacatcttaccccagaaggccatcacggccgggaagggctacgaggactggaccaccatcgaccccagcttcaccttcctattcagcctcttcccgaacgacctgatccagattgtgcccagcaagaacaagacgatcaaggcgcgcaccaccgtcagcaagaaggaggtgctgctccccagcctgaccggctacttcaagggggtgcactccggcacggccgggatcaccgtggagacccacgacggcagcgtcatcgccaacgtcgggtccaagcagctgctcctgttcgagaagtaccaggtggacgtcttgggccactacaccaagatcaaggaggagaaacgaataggcatggccatctga

SEQ ID NO: 7320 - RNA, 3210 nt, synthetic construct
  misc_feature 1..3210: note = Cas9 variant
  source 1..3210: mol_type = other RNA
atgaagaaacagccacagagatacatcttgggcctagaccttggcatagcatccgtcggctgggccctaatactcgtcgacggggccgaaaaccccgtcggcctattagattgcggcgtaagaaccttcgaaagggcagaagtccccaaaacgggcgacagcctcgcactcgcacggcgccaagccagatctgtacgccgcctcatccgacgacgagcgcacagactcctccgtctacgccgcctcctcaaacgggaaggaatattatccgcagcagacttcaactcagacggactgcccaacctacccatcgacgcctggcaactgcgcgtagccggtctagaacgaaaactaacgaaccaagaatgggccgcagtgctcctccaccttgtcaaacatcggggatacctctcgcaaagaaaaagcgaaactcaaacggagaacaaagagttggggcgcctcctagccggtgtcgcagaaaattccaaactactcagcgaaagcagcgaacagtacagaaccccggcagaactagcagttaaactattcgccgagcaatccggacgcctcagaaataaaggcggcgactacacgcacacgtttaaccgactcgacctccaaaaagagctacacctactgttcgaacgtcaatgcgcactaggaaaccccttcgcctcggcagagctccaatcaaaagtagacgaacttctaatgacacagcgcagtgccctacagggcgaagccgtcctaaaaatgctaggcaaatgtaccttcgagccgtcagaatacaaagcagccaaaaatacctactcggccgagcgattcatatggcttacaaaactcaacaacctaaggatcctatacaacggcgaggaccgagcactggacgagggagagcgaaaacagctcctcgacgaaccatacaagaaagcaaaactcacatacaaacaagtccgcagcatcctgaacctaccagaatcagcggtattcaaaggtctccgatacggaaaagacagcgacggcctaaaagcggagaacggagccctgatggaaatgaaggcataccacaaaatccgaaccgtactggagaaggccggactcaaaggcgaatgggaaaaccgcattcgaaacccggagattctcgaccaaatcggcaccgcattctccgtatataaaaccgacgaagacatcaaagccgaattagccgctctccggctgcctgaaaacgtcctggacgccctgctagccgggctaaacttcgacaaattcatacaactctcactaaaggccctatccaacatactccccctcatggagcgcggaatccgctacgacgaagcctgcaaagaggtgtacggcgaccaccgagcactagcggaaagcaaaaaccagatgctgctaccccagataccagcaaacgagattagaaacccggtcgtcctccgaacactaacacaagctcgaaaagtaatcaacgcaatcatacgcagatacggctccccacaaagggtccacatcgaaaccgcgcgcgaactcggtaagagcttcaaagatcgcaaagaaatagaaaaacgacaagaggaaaaccgcaaagaaagagagcgagccgcagaacatttcaaagaactattcccgcgctttacgggagaaccaaagagcggagacatcctgaaattacgcctctatcaacaacaacaaggaaaatgcctgtacagcgggatacccatagacctcggccgcctgaacgaaaaaggatacgtagaaatagaccacgccctaccattctcacgaacatgggacgactccttcaacaacaaagtcctcgtcctcggatcagaaaatcaaaagaaaagaaaccaaacgccgtacgaataccttgacggagcacgggacagccaacgctggcgtgagttccaagcccgcgtacaaggctgcaggttcccctacgcgaagaaacaaagaatccagacagccaaattagactcaaaaactgaacaaggattcctagaacgaaacttaaacgacacacgatacatagcacgatttctctgcgggtttatagagaaatccctacatctccaaggcgccggcaaaagacgagtattcgcatcaaatggtcaaataacggcgttactacggggactatggggactgaagaaagtacgcgaagacaacgaccggcaccacgcgctcgacgctatcgtggtcgcctgctcaacagttagcatgcaacagaaaatcaccaaagcaatgcaacgcagagaaaccctagaaacgataaacacggagacaggggaagtcaaaacacgcatcccccaaccctgggacttcttccgccaagaagtcatgatacgcgtcttcagcgacgcaccccgcgaagaactagccgaaaaactcaactcacgccccgaagcactacacgacttcgtaagcccactattcgtatctcgggcgccaaaccgaaaaatgacagggcaaggacacctcgaaacagtgaaatcagcaaaacgcctcagcgaaaacatcagcgtcgtgaagaaaccactaacagcactgaaactcaaagacatcgaaaacatagtaggatatccagaccgcgagccagccctgtaccgcgccctccaggaacgcctccaagcatacaaagatgaccccgccaaagcattcgccgaacccttttataaaccagccaaagacggcggccaaggctcattagtcaaagcggtacgaataatcgaaaacaccaaacacggactaaaagtgcggaacgggatcacagacacgaatggcgacatggtccgagcagacgtataccagaaggccgataagaaaggtaaacgacaatacttcatagtccccgtatacgcatggcaggtagagaaaaacgaactcccgacagttgactgcaagggatacgaaatagacgacacctacgagttctgcttcagtttatacaaatacgacatcatagaaatacaaaaccccgacaatatgagcaaagaactccgcgtctactacataaactgcgactcatccgacgggcgattctggctggcacaccacgacaaatcggcaaaagaacaacaattcaggatatcaacacagaaccagcccataataaagaagtaccaagtcgacccgctcggaaaagaaatccgactatgcaaagcggagaaaagaaccgaactaaatggaaagaagaagaaatga

SEQ ID NO: 7321 - RNA, 3210 nt, synthetic construct
  misc_feature 1..3210: note = Cas9 variant
  source 1..3210: mol_type = other RNA
atgaactacgacatcggactgcgcatcgggatcaccagctgcggctggtccatcatcaacaaggacctcgagcggatcgaggacctgggggtgcgcgtcttcgagaaggcagagaaccctgatggaaccgccagcgccgccccgcgtcgcgaggcccgtaagtcgcgccggaagcaccgccggaagaagcaccgcatcgagcgaatcaagcgtctgattgtgcagcacgatctcctgagcaagaaggagctggactccctctacctcagcccattcaacatcgacgtgtggaacctgcgggtcgaggccctcgagcgcaagctcgacaaccgggagttcgccagagtgctgatccacctcgtgcagcgacgtggcttccagaccatccggaaatccgtcgagatccaggaggagggtaagctgctggagaatgtgagcgagaacgagcgcatcatgaaggtgaacgggtacaagaccgtaggggagatgtttagcaagcacgagaagttcacccaccacaaacggaataaagacggcagctacacctcggtggtaacgcgcagcctcctgctcaaggaaattaagaccatcttcaactcccaacgcatcctcgggaacgtcttctcaacccaaaaactggagtccgactacctgtacatctggggaagccagcggccgacactaacttacgagcagctgatgtcaatggtggggaactgcatctacgagaagaaggagaaacgcgcgccgaagacgtcctgggccttccagtacttctccctgctccaaaagatcaacaagctcaaggtgagcgacgacaataccctgcggaagctcagcaaggaggagcgcgacatcgtcatcgagttggcttttaaaaagaaaaacgtgtccttcgtggacatccggaaggccctgaagctaaacgataacaccaagttcaaccacctgacgtacagccacgtcgtggagaccaagaaggtggagaaggcgaccttcatcgagttaaagggctaccacctcattaagaagcagctgaaggaccgcaacgttgagctaactcaagaactccagccgaaggactacgatgccatcgccgccgcctctacgttcttcaaaaacgacatagagtttcgggactacctgcgcaaccagtacctggacagcaacggaaagcggaagtccaacatagcgaacaaggtgttcgaagacaaggtgatagccgccgtcttcgagctcaacttcagcaaggtgtgccacctgagcttcaaaagcctgtacaagctcatcccgcacctggagaaagggctggactacaaggaggccatcctctgcgccggctacaacttccgggacgagaacaagcgtgacaagaaacttttccttcccgtcattcagcaagagaccaaccccgtggtccaccgcgcactcacacaggcccggaaggtgatcaacgccatcatccgcgagtacgggagtccgaacaccatcaggttcgtagtggccaatgacctggccaagacgtacaagcagcgcaaggagctggagtcgactttaaagaagaatcgggcggagaacgagaagatcaagaccaagctcctctccatgggcatcatcaaccccaccgggatggacatagtcaagtacaagctgtggtacgagcagagcgggatctgcctctacacgggccgccagatggagctgtccagcctgttcaagcctgggtactccatcgttaaccatatcatcccctacaaccggagcttcgacgacacctaccacaaccgcgtgctcaccctgaccgagacgaagtacgagaagggcaacaagatcccgttcgagtacttcggggccgaggagacctgctggaacgagtacgagaagcgcgtttccaccagcaagaagatccacgacaagaagcgggaaaagctgctcatccgcaatttcgatatcgagtacgagaacgagatgatttccaacaacgtgttcgacacccactatatcggcagttactttgagaaatacatcgatgagcacctccagttcaaaaagtccacgaagaagcagaaggtcttttccatccacggaaacatggtcgcccacctacacagccgatgggggttcaacaagaactcccgcgagatatacctgaaccacgctgtggacgccgcgatcgttgccgtcctgaccgaccagctgatccggaacatcgccgattactatcgccgggacaacatcctggagcagaagggtagcctgaagttcccagagccctggaagtccttctctatcgagctggaggccaggatcagcccccaggtccgggacctcattaagaagctgaacctggacagctacctcgacgtggacatcctgcatatcaagccggtcttcatcagcaagaagcccagacggaaggtgaacggggaggcgcacaagagcaccatcagatccctgatcggcatcaacgagatcggcaagaccgtgacgtgcatcaagacccggctcgaggacatccccttcgacgagaacggggactttcccatgtacggcaaggacaccgacaagtacacctacaccgccatcaaagaacgatacctggagttcaacaaggataaagagaaggccttctcgacgcccctgtacaagctcaagcggaacggggagcccggcaaccagatcaagtccgtcaagataatcgacaccaggaacatcgttaacaaagtgaaccagggtaagggcatcgcctacaacagcaacatcatcagagtcgacgtgttttccagggaccagaagtactacgtcgtccccatctacctgagagacttcattaaggggagcctgcccaacaagataatcaccgccgcgaagggcttcatgcagtggccggagaccgacaactcctacactttcctcttcagcatcttccccaacgacctgatcaaggttgtgcccaaggagggcaagtttatcaaggctaagaacgagaacaaggagaacatcaacctcaccgagatccttgggtacttcaagggcctggacagcagcacgggggccttcaccctggaaagccacgacggctcccttctggcccgcggcatcgggacgaagaatctgctcctgatcgagaagtaccaggtcgacgtgctgggccggtacaacaaggtggggaacgaggagcgccaagacatcaagatccagcaaaactga

SEQ ID NO: 7322 - RNA, 3210 nt, synthetic construct
  misc_feature 1..3210: note = Cas9 variant
  source 1..3210: mol_type = other RNA
atgaactacgacatcggcctgcgcatcgggatcaccagctgcggctggtccatcatcaacaaggacctcgagcggatcgaggacctgggggtacgcgtcttcgagaaggccgagaaccccgacggtaccgccagcgcggccccgcggcgcgaggccagaaagtcccgcagaaagcaccgccgtaagaagcaccgcatcgagcggatcaagcgcctgatcgtgcagcacgacctcctgagcaagaaggagctggactccctctacctgtcacccttcaacattgacgtgtggaacctacaggtcgaggccctcgagcggaagctcgacaaccgcgagttcgcacgggtgctgatccacctcgtgcagcgacgggggttccagacgatccgcaagtccgtcgagatccaggaggagggcaagctgctggagaacgtgagcgagaacgagcggatcatgaaggtgaacggctacaaaaccgtcggggagatgttctccaagcatgagaagttcacccaccacaagcgcaacaaggacggcagctacacctccgtggtgacgcggagcctcctgctgaaggagatcaagaccatcttcaactcccagcgcatcctcgggaacgtcttcagcacccagaagctggagtccgactacctgtacatctggggcagccagcgccccaccctcacgtacgagcagctgatgtccatggtggggaattgcatctacgagaagaaggagaagcgggcgcccaagaccagctgggccttccagtacttctccctgctccagaagatcaacaagctaaaggtgagcgacgacaacaccctgcgcaagctcagcaaggaggagcgggacatcgtgatcgagctggccttcaagaagaagaacgtgtccttcgtggacatccgcaaggccctaaagctcaacgacaacaccaagttcaaccacctgacgtacagccacgtcgttgagaccaagaaggtggagaaggcgaccttcatcgagctgaaaggctaccatctcatcaagaagcagctgaaggaccggaacgtcgagctgacccaggagctccagccgaaggactacgacgcaatcgccgccgcctccacgttcttcaagaacgacatcgagttccgcgactatctgcggaaccagtacctggatagcaacggcaagcgcaagtccaacatcgcgaacaaggtattcgaggacaaggtgatcgccgccgtcttcgagctcaacttcagcaaggtgtgccacctgtcctttaagagcctgtacaagctcatcccccacctggagaaggggctggactacaaggaggccatcctctgcgccggctacaacttccgggacgagaataagcgcgacaagaagctgttcctgcccgtcatccagcaggagaccaaccccgtggtgcaccgggcgctcacccaggctcgcaaggtcatcaacgccataatccgggagtacgggtccccgaacaccatccgcttcgtggtggccaacgacctggccaagacgtacaagcagcggaaggagctggagtcaaccctgaagaagaaccgcgcggagaacgagaagatcaagaccaagctcctgtccatgggcatcatcaaccccaccggcatggacatcgtcaagtacaagctgtggtacgagcagagcgggatctgcctctacacgggccggcagatggagctgtccagcctgttcaagccagggtactccatcgtgaaccacatcatcccctacaaccgcagcttcgatgacacttaccacaaccgggtgctcactctgactgagacgaagtacgagaagggcaacaagatcccgttcgagtacttcggggccgaggagacctgctggaacgagtacgaaaaacgcgtctccaccagcaagaagatccacgacaagaagcgcgagaagttactcatccggaacttcgacatcgagtacgagaacgagatgatctccaacaacgtgttcgacacccactacatcggcagctacttcgagaagtacatcgacgagcacctccagttcaagaagtccactaagaagcagaaggtgttctccatccacggcaacatggtcgcccacctccactcgcggtggggtttcaacaagaactcccgggagatctacctgaaccacgccgtggatgccgcgatcgtggccgtcctgaccgaccagctgatccgcaatatcgccgactactaccggcgcgacaacatcctggagcagaagggcagcctgaagttccccgagccctggaagtccttcagcatcgagctggaggcccggatcagcccccaggttagagacctcatcaagaagctaaacctggacagctacttagacgtggacatcctgcacatcaagccggtcttcatcagcaagaagccccggcgcaaggtgaacggggaagcgcacaagagcaccatccgttccctgatcggcatcaacgagatcgggaagaccgtgacgtgcatcaagacccgcctcgaggacatcccctttgacgagaacggcgacttccccatgtacggcaaggacaccgacaagtacacctacaccgccatcaaggagcggtacctggagttcaacaaggacaaggaaaaggccttcagcacgccgctgtacaagctcaaacgcaacggggagcccggcaaccagatcaagtccgtcaagatcatcgacacccggaacatcgtgaacaaggtaaaccaggggaagggcatcgcctacaacagcaacatcatccgcgtcgacgtgttctccagggaccaaaagtattacgtggtccccatctacctgcgcgacttcatcaaggggagcctgcccaacaagatcatcaccgccgcgaagggcttcatgcagtggccggagacggacaactcctacacgttcctcttcagcatatttcccaacgacctgatcaaggtggtgcccaaggaaggcaagttcatcaaggccaagaacgagaacaaggagaatatcaacctgaccgagatcctcgggtacttcaagggtctggacagctccaccggggcctttaccctggagagtcacgacggctccctcctggcccggggcatcgggacgaagaacctgctcctaatcgagaagtaccaggtcgacgtgctgggccgctacaacaaggtggggaacgaggagcggcaggatatcaagatacagcagaactga

SEQ ID NO: 7323 - RNA, 3213 nt, synthetic construct
  misc_feature 1..3213: note = Cas9 variant
  source 1..3213: mol_type = other RNA
atggctacacgcttgggactcgacataggaaccaactcaataggatggtgcctgtatgacggcgactcaatcagagacatcggagtacgcatcttcttagacggcagagaaccaagcaaactaaccgtaagtggcagcggcacacccctagccgtaaaaagaagggacgcacgcggagcacgacggagacgcgaccgctacatcggccgacgaagcgcaatgctacgagaattaagaaaacacggactactaccggccgacccaaaacaagcgaaggtactcgaaacacaagacccatacgccctacgcgtcagggccctagatgaaaaactagagccccaccaaataggacgagcactcttccatctaaaccaacgacggggattcaaaagcaaccgaaaggccgagagggcctcaaaagccggggaagacggaaaaatagccacggcaacgaaactactcgacgaagagatgcagcgccttggagcacgaaccctcggagagttcctcgtgaaaagagactccgagttcgacggagaagcgggaaagcgtgtacgaatgcgagcggacagtaaagcatacgacttttaccccgaccgccgacacgtgctggacgagttccgagcaatatggaacgcccagaaggtatggcacccggaactattaacagaacaagcatggaacgacatcttccgagtcatcgaataccaacgcgaactaaaaccacaggtcgttggccactgcacatttgcggggataaacggcgtcccagcagacgagaaaaggctcccaaaagcccatcccctattccaacaacgacgcctttacgaagaagtaaaccagctcaaggtggtcgcgccgggagaagcaggccggccactaacacgggatgaacgagacgcactcatactaaagctacaagacaagaaaagcgtcagcttcgagacactggggaaaacactaaaactaaaagatggagaacgattcaacaaagaaagcgaaaaccgcaaagccttagacggcgacgaggtaagggccgcactctccgggaagaaactgttcgggacccgatggttccacttcagcgcagaagaacaatggatgattatcgaacgactactcgaagaagaagactcagagacactgctgacctggctcaaaataggctacagactcgacgacgaagcagccctagcggtcgcaaacgccaagttacccgaggggcatggacgattcggactgtcggcaacaacggcactgctaaaagaactcaaggccgacgtctgtacctacgccgaagcagctaaaagagcagggttccaccactcagacttccgcaccggcgaggtcttcgaccaactaccgtactatggcgaaatcctggccagagaaatcgccccagggaagcccgagtatggcgacgagaatgagcgaaggttcggaaaaataacaaaccccacggtacacatcggactcaaccagctaacgaagctcgtaaacgcgatcattagactccacggaaaacccgactatatattcgtcgagctggcccgcgagctaaaactaaacgaaaaagagaaaatcgcctacaaccggcaactaaaagaaaacaccgacgccgccagagacaggggagcaaaactaggaaccatgggagttagagacacagggaggaacagattaatactgcgactctggacggaattaaaccccggcgatgccctgaacagacggtgcccattctgtggcgaacaaatctcacagaggatgatacaaaacggcgaggtcgaaatcgaacacatcataccgtacagccaatgcttcgacgacggtatcggaaacaaagtactatcccacgtgagatgcaatcgccagaaaggcgatcagacaccatgggaaaggtggggacatgaccccgacagatggtcaataatccaagaacaagtagcccacctccacaggtcaaaacaatggcggttcgggcccgacgcaagagatcgatacgccgccgaagaagatagcttcttgccacgccaactaatagatacacagtacctcacccgtatagcagccaaatacctcgcatgcttataccccgagcgaggcgaacgccacgtattcgcagtccacggaggtatgaccgctatgttaagacgactatgggacctcaactcaatactactagaccacaactgggtggagaacttaaacagcaacgccccgaaaaacagactcgaccaccgtcaccacgccatcgatgccgccgtagtaggcatcatgacacctgggctgatagcagaaatcgccaaagcagccgcacgcgcagaaaaacaaaatctagaccgattattcgaagaactgcctatgccctgggcacaacatcccaacgatcgaaggttccgcgacgaactgagagagaaaatacttgcagcgacagtatcacacaaggcggaccacggaagacaagggaaaccagaaagaggcagggacataactgcgggcaaactccacaacgacacggcatacggatttacaggcctgacctcagacaccgggctacccgtcgtagtacaccgagtcccgctaaccagcctcacaccgaaagatatagcggatcccgacagaatacccgacaccaccctacgagggagcttatggcaagccaccagagacctatccggtaaggagttcgaaaaagccctactagacttctctcgaacgcacgctcaattcaaaggaatcagacgcgtgcgagtacgagaaggcctaacactaataccaataagaaaccacgcaggaaagccctacaaaggctacctaggagacagcaatgcccgatataacgtatggcagatgccggacgggcgatgggtccatcaagtaatctcaacattcgacctacaccaacctggcttcatagaacagcgcccacacccagccgccaagaaggtactatcactacgccaaaacgacttaatagctatcgaacgagacggagccctgcgacaaataatgcgagttcaaaaatacgggcagaatggccaaatatttttaatcgaacacaacgaagcaggcaacatggcagaaagaaacaaaaacacggacgacccattcaaattctacggaccaggcgccagcgccctgcgaaacatgaaagctaggcaggtacgaatagacgaactcggaaggatattcgaccccggccctcgctga

SEQ ID NO: 7324 - RNA, 3213 nt, synthetic construct
  misc_feature 1..3213: note = Cas9 variant
  source 1..3213: mol_type = other RNA
atggcgaaagacttcgaatacatactgggcctagacctaggggagacgtccattggatggtccgtggtacgcctgaacgagggagtacctgaacatctggaacggctaggagtccggatctgttccgacgggcgagacgcccaaagccacgaacccctctcagtcgcgagacggatcgcgcgcggactccgtcgtcgaagagacagatacatacatagacgaatccgactaacagacgtccttgtcaaatatggcctaatgccagaggacatcaaagagcgaaagaaactccaagcgctaaacccataccgactgcgctcagaggccctagacaggaaactcgaaccgtacgaactaggcagagtattgttccacataaaccaaaggagagggttcaaaagcaacatgaaaacagaccgaaaggacagcgaatccggagcaatgaaacaagcaatattaaaaacgcgcgcaaaaatggaagcgtccggagcacgaacactaggcgagttcctgtacttccttaacaaagacaaaacaagcacacaagaatacgtaccagtgagaatgcggagccactcggaaaagaataagactgtatacgagatgtatcccgaccgggcaatgtatgaggacgaagtgcacaaaatcttcgagcaacaagaactaagccccgaagcacagacagagatctttaacacgatattcttccagcgcccgctaaagccggtggagctaggcttctgcgagttcgaagacggagaacgacgcgcgtacacggcctcggtcgtctttcaaaagtttagagcactccaacaaatcaaccaaatttatgtgcaagacgactacgaacgcagacccctgaccaaagaagaaaaagacatcctgaaacatttcctgctcgaagatttcagcgcacttgacaagaacggcctgctgacttgggccaaagtaagaaccctactaaaactccaaaagaagaaattcaacctagagagcgaacgcaggaaaggactaaacgcagacgtcacaagttggaaactatcaaacgcagcctgcttcggacgagagtggttctcattctcggacgcgaagaaagaagagatcgtagccctcatcaccggagccgaaaaagaagaggaactaatcgccgaacttaaaacgaaatacggcctaagtgacgaacgcgctaaaaacacagccaacgtgtcgctacctgatggcgtcgcaagcctctccgccaaagcaatgaagaaattaataccctttctagaagagggcatgctctacgatgatgccgtcaaacaggcaggatacgtcttctcaagctcgttcaaaggcgtgctccccgagaaatatgaaacattcatcgagcccgaaagcggagagtgcttcgacgagctaccatactacggacaagtcctaagaaggtacgtacttggaggagtcccgtccgaagaaaacaaactcttcccggaaaaatactacggaaaaatcaacaacccaaccgtccacatagtcctaaaccagctccgcaaactgatcaattccctcgtagcaaaatacggccatccgaggaaaatagtggtagaaatggccagggacctaaaactatcgaagaaacaaaaagacgcaatcgccaaagaacaagccttaaacgaaagagagaacaaaagaataggcgcagaattagaaaggctagacataaggaacaactacgacaaccgaatgaaatacaaactctgggaagacctctcaaccgatcccacgaagaggagctgccccttctgcggaaaacaaataagtcaacaggacatcttcagcccggagttcgaaatcgagcacctaatcccattttcgagatcgttcatggacggaagaagcaacaaagtcctaagctgccgaagatgcaaccgcgagaagggaaacaagaccccattcgaagccttcggcaacgactcgacacgatggaatgcgatcatgggccgcgtggaatcacttccagagaacaaaaggtggaagttcgcaagcgacgcaatgagccgctttgaacgggatggtgacttgctagcaagaatgatgactgacacccaatacatggcccgtatagcaagaagatacctctgctgtgccgcaaaccccaaccaggtatacggaatacctggacaactaacggccaaactgcgcgagcactggggcctcaactccatcctgtccgaccaaaaagaaaaagacagaagcgaccacagacatcacgcaatagacgcattcgtcgtagcctgcacagacagaggaacactccagaaatactccacagagagaagagactacgcgaaacccgaaatgccatctgagaaagccccacacattccgttcgccgacttcagactgagcgacataaaaagagtcttcgacgaaatcatagtatcgcacaaaccagaccgaggaaacgcgcgtgccgccatcctcaagggcggaacagtagccaaactacacgaagagacctactacggcatgggcggagaaggaagtaaaaagggaacgtggaaactgatacaaagaatccccgtcagcgaaatcaagaaagcatcagacttagattgcctgatagaccaaaaaggcacagccaacccactaagggtactcctcgtaggagccagtgagtcggagcaagaacaaataatagccagctacttcgcacgccgaggaacgcacaaagtcagaacataccgggagcgcaacaaagacgtaatccttccgttcaaggacaaagacggaaaattatacaggtatgcagtatacggctccaacgcgtacgccgaaatatactgcccagaccgaggcaaaaacgccggcaaatggcaagtagaaataatcccaaactactgcgcgcaccagaagggtttcatacccaaatggcgacacaccgacgcccacgcaaagttgatcatgaggctgtacaggaacgatatggtagcctacgaaaaggagggaaaaaccgtcatcgcccgagtaaagaaaatgggaggcaacggggtgatcgtgttccgcaaccacctaatcgcaaaagaggaaggtgatcgactgtcatggcaggctgtagtatcgggaatgcaaagtgccaacttacggaaaatctacgtagacgtgctcggaagggtgatcgacccaaaaagacctatgacccaaaacgagaccgatggacaagacaactga

SEQ ID NO: 7325 - RNA, 3213 nt, synthetic construct
  misc_feature 1..3213: note = Cas9 variant
  source 1..3213: mol_type = other RNA
atgagccacttccgacttaaacaattaaactacatcctcggcctagacctaggaatagccagcgtagggtgggcagtagtggagatcgacaccgaggaaaatcccactaggctcatcgacgtcggagtacgcaccttcgaacgcgcggaagtgccaaaaaccggcgatagcctagcagctgcgcggagacaggctcgctccgcccggcgactaatacgccgacgcacccaccgcctgctacgcgcacgacgactcctgaaacgcgaggggatcctccatgccgacgacctaaacgcggaaggcctcgtaaaagaactccccaacaccccctggcagcttcgggtagacggcctagaccgcaaactcatgcccaaagaatgggccgcagttctgctacacctggtgaaacaccgcggctacctctcccaacgcaaaaacgaatccgaaggagctgacaaagaacttggacgactcctcgctggagtgcacgaaaatcaccaggcactacaaagctccgagtacagaacaccagccgagctggcggtcaagaaatttcaagcgcagtccgggcacatccgcaaccaacgcggagactacacccacaccttcgacaggaaggacctacaacaagagttacaccaactattcgccgcccaacaaaaatacggcaacccgtttgtgtcggacggccttaagcaaggcatagagaccctcctcatgcaacaaagacccgcactctcaggagacgcagttcagaaaatgctgggaaggtgcacattcgaaacggaagagttcaaagcggccaaacacacctacagtgccgaaagattcatatggctaaccaaactaaacaacctcaggatacaagaaaacggcaacgaacgctgtctcactgcccaggaacggggccagataatcgacctcccatacaagaaagccaaactcacgtacgcccaggtacggaaagaactatcactcccggaaaatgcgttcttcaaaggactacggtatggaaaagagaacgcagaaaccgctgccctaatggagatgaaggcttatcacgcaatcaggaaggcactcgaaaaagcaggattaaaaacagagtggcaaggactggcgtgcaagccggaactactagacgctatcggcaccgtattctcactgtacaaaacagacgaagacatcagcacccgccttcaaggacaactgagcgaagacgtcataaacgcactcctcgctggactcaacttcgacaagttcatacaactgagtctaaaagccctcagcaaaatactccctctaatggaacagggccaaagatacgacgaggcccacgcagcattatacgtgcgcagcacaccccaaccccaaagactgctaccgcagataaccgccgacgagatatgtaaccccgtagtcctaagaacgttatcacaggcacgcaaagtcatcaacgctattgtacggcggtacggcagcccagcaaggatacacattgaaaccggtagagaagtcggcaaatcattcaaagaccgccaagaaatccaaaaacgccaagaagacaaccacaaagaacgcaaacaagccgccgaaaaatttctcgagtattttccaaatttcgtaggacaacccaaggccaaagacatcctcaagctccgactatatcaacaccaacacggacaatgcctctactcagggaaaactctggacatctgtcgcctcaacgagaaaggctacgccgagatagaccacgcgctcccattctcacgaacctgggacgattccttcaacaacaaggtcctagttctggcaggcgaaaaccaaaacaaaggtaaccagaccccatacgaatggctaggaggggcatccaactcgccccgatggcaggagttcgtagcccgggtcggcagcagccgcttccaccacagcaagaaacaaagaatcctcctgaggcagcttgacgaggagggatttaaagaacggaacctcaatgacacccgatacgtagcccggttcctatgcaaattcatcgaggaaaacatgctgctcttaggcagaggcaaacgcagagttttcgcctcaaacggacaaatcacttccttccttcgatcccgatgggggctccgaaaagtccgagaagaaaacgaccgccaccatgcgctagacgccgtggtcgtagcctgtagcaccgttgccatacaacagagaatcacttactttgtgaggcaacgtgaaatgaacatcttcgacggcgaactgatagacaaagaaacgagcgaagtatcccgaccctacttcccccagccctgggacttcttcagacaagaagtgatgatgcgcgtcttcggcaaacccgacggagatcccagcttccccgaagcggacaccaaagaaaccttatgtacactactcgaaacacgactcagctcccgcccgcaagcggtacacgaatacgtcacacccctattcgtaagtagagccccgacccgaaaaatgagcggtcagggccacaaagagaccgtcaaatcagcaaagctgctacacgagggaaaatccgtcctccgcgtacccctcacccagctaaaacctaacctactggaaaagatggttaaccgcgaccgcgaaccccaactctacgaagcacttaaggaaagactcgcagcctacggcaacgatcctgccaaggccttcgccaccgagttccgcaagaaaggcggccaactggtcaaagcagtacgggtagaagacacacagaaaagcggcgtactactacacaaaggcacaggagtcgctgacaacgccacaatggtccgggtagacgtgttcgaaaaatccggaaaatactacctagtgccgatatatagctggcaagtagcccagggaatactcccaaacaaggcggtgatccaaggtaaagatgagaaaaactgggacgaaatggacgaaacctacaccttcaaattctcaatgtatcccaacgacctcgtcgaaataaacacaggtaaacaacggctgttcggctactacatcggactagaccgcgcaactggagcgatatccatccgcgaacacgatctagacaatttcaaagggaaaaacggaatatacagagtaggcgtcaaaacagcgatctcgttcaagaaatatcagaccgacgagctgggaaaagtagtggttccttgccggcccaagaaacgactcccagtccgctga

SEQ ID NO: 7326 - RNA, 3216 nt, synthetic construct
  misc_feature 1..3216: note = Cas9 variant
  source 1..3216: mol_type = other RNA
atgcggctaggcctagacatcggaacaaacagcatcggatggtggctataccaaacagatgacggcacaataaccgacgtactggacggaggcgtgaggatcttctcagacggccgcgatccacaatcaaaggaatcgctcgccgtcgacagaagagtagcccgagcacaacgcagaagacgagaccgctatctaagacgaaaagctgcacttatgaagcgaatggccggcgcaggtctcatgccaaccgaccaagctcacgcgaagaaactcgagtcactagacccttacgcccttcgcgcagaaggacttgactgcgaactgcccttgacacacctcggccgagcattgttccacttaaaccaacgccgggggtttaaaagcaaccgaaaaacagacaggggcgacaatgaaagcgggaaaataaaagacgccacggcgcgactagactgggcgatgagagacgcaaaagcccgaacgtacggcgagttcctccatacacgacaacaaaaagccgacgacccgaaaagaatgccaacagtaagaacaaggctaacagtcgcgcgccgagacaatgctgaaaaggaggaagcagggtacgatttctacccagaccgcagacacctgtcagaagaatttgatgcactctgggccgcccaagctgactaccacgaagccctgagcgacgacctaagagatcagatcaaaacaatcatattccaccagcgaccactcaagacacccgaagtagggctatgcctattcacagacgagcgcaggatacccagcgcgcacccccttaaccaaagacgcatcttactagagacagtcaatgccctgagaatagtcgcacgaggcgaggcggcccgccgactaacacttgaagaacgagaccaaatagtccacgccctagacaataaaaaccacaccaaaaccctatccggtatggcaatgaaactcaaagcactagggaaagtaatccgcctgaggagcgaccaaacattcacgctcgagacagccaatagagacgccatagcatgcgacctggtgagagccagcctgagccaccccgaccgcatgggcggagtttggaccaccctcgacgaaggagcacaatgggaagtcgtacagagaattagggcggtccagtcggactccgagttcgatgcgctcgtggtgtggctagaacagaaccatggactcgataacgcacacgcccaagcgacagcaaacgcaccgttaccagaaggatacggtcgcatggggctaatggccacgcgccggattcttgccgctctccagagcgacgtgatgccctacagcgacgccgtcgcagcctgtgggtggtcacacagcggcggaccaacgggcgaagtcctggaaaaactaccctactatggaaaaatacttgaccgacacgtgatcccgggcacatacgacgaaaacaacgaagacgtgaaaaggtacgggcgcattacgaacccgacagtccatattggactaaaccaaatacgaagactcgtcaacaggatcatatgcatacacggaaaacccgacgaaattgtagtggaactggccagagacctgaagaacagcgaagaccagaaacgggagatccagaaaataataaagaaaaatacggatgcagcaataaaacgcggtgaaaaactcataaacgaactaggacaaaaagacaccggcgcaaaccgcttagtcttaagactctgggaagacctaggccacgatgtaatgaccaggaactgcccctacagcggcaaacggataagcgcaggcatgctattcgacggttcctgcgacgtggaccacattctgccatactcacgaacactcgacgacgggattgccaacaaaaccttatgtcttaaagaggcaaaccgacaaaagtcaaacaacaccccctgggaagtatggggagaaacggagcaatgggacaccatagcggctaatctcaaaaacctacccgacaacaaggcatggcgcttcgctagcgacgcaatgcaacggttcgaaggcgaaaacgacttcagcgcacgtgcactaaaggacacacaatacctcagccgaatcgcccgggcgtacctcgacgccctgtacgacggcggggacggaaactctcacgtatgggtggtcccgggcagactaaccgagatgctccggagacactggggattaaacggactggaagccctcacagacagcgacgaaaacaccgtaaaagccaagaacaggatggaccaccgtcaccacgccatcgacgcggccgtagtcgcagccaccgatcgaggcctcatacagcgaatatccaagatcgcgaaaagggacgaacaagcgggagccgaagaagttgcaagatccgtctccccgccctgggacggcttcagagacgacatagcagcccaactaagtcggataatagtctcacaccgagcagaccacggaagaattgacagccaggcaaaacaacaaggagaggatgcgacagcaggacaactacatatggacacggcctacggcgtcgtagacgcagggcgcgtagttagccgaaaacccctgctgtcactatccgaatcagacataaagaaaataagagaccccgatctccaaagacacctaactcgcgtaacaaaaggactcgataagaaagaatttgaacacgcactgtcagacttcgctaacgccaggaaactccccgaccaaagcgaaaacccatacttcggaatgcgccgcgtgcgcctcattgacgcactacaggactcagcaagggtaagcgtacgagaccgagacggccacatatataaggcgtacaaagcgggcagcaaccattgctacgaagtatggcgactaccagacggcaaaataaaaccatgggcgataagcactttcgaagcgcaccagaccggtaccgaaagcaaacctcacccagccgcgaaacgactcctacgagtcttcaaacgcgacatggtcgcgatcgaacgcgatggagaaacactgatgtgctatgtacagaaaatggacatcgcaaacggcctattcctcgtaccccacacggaaggtaacgccgatgccaggaaccgagataaagacgactccttcaaattcatacaaatgagcgcggtcagtctcatacgggccaagatccgacgcatccacgtcgacgaaatggggagactgcgagaccaagggcccccaagatga

SEQ ID NO: 7327 - RNA, 3216 nt, synthetic construct
  misc_feature 1..3216: note = Cas9 variant
  source 1..3216: mol_type = other RNA
atgcgctacaccatcggcctggacatcggaatcgccagcgtgggctgggccgtcatcaacgaggacaagtcccggatcgaggacctcggggtgcgcgtgttcaagaaggcggaggagcccgacggcaagagcctgaatctggcccggcgcgaggcccgggggagtcgccggcgcatccggcgccgggccacccgcatgcagaaggtcaaagagctcctggtgaagtacaacctggtgtctgagaaggagctcgagacgctgtacatcatcaccgagaccaccccagacgtctacgagctgcgggccaagggcctcgaccgcctgctgtcccggcaggagttcgcgcgcgtgctcacgaacatcgccaagcggcgcggctacaagagcaaccggaagatcgacgaggaggacaaggaggtggggaagctgtccaagggcaccatcgaaaacaagcgcatcctgcaggagaaggggtaccggaccatcggagagatgttctacaaggacgagaagttcgagtacaacaagcgcaacaaggccggtgagtacaacagcaccgtcctccggtccatgctgatcgacgaggtgcacacgctctttgagatgcaacgcaagttcaaaagcgagttcgccaacgaggagttcgagaaggagtacgtggaggtcatgacctaccagaagccctacatcacccccgagctcctggagaagatgctgggcaagtgcaccttcgagaagggcgagccccgcgcgccgaagaactcctacacgttcgagcggttcatgctcctgcagaaggtcaacaacctgaacatctacatcaatggggagaaggtggagatcccccaggagaagaagaaggagatcatcgagctcgcgtacaagcagagcgagatcaagtatacccagctgcgcaagaagctggagctacccatcgaagcccggttcgccgacctgaactaccagatcaagcgcaccgaggacgagtccgaggaggccctggtcaagaagatcgaggacaaaaagttcgtgaagctcgaaggctggcacaagatccggctggcgctgaaggagaacaaggacaagttcgagaagatcgagaagaaccccgagctccagaacatcatcgccgacgccctggtgcgcaacaagaccgacgagacgatcaagaactacctggagaaatccgacatcgacgaagaaataatcaacgccatcctcaacatcaactttaccaagttcgggcacctgagctacaaggccatgaataagattatcccggagctggagaagggcctcacgtacgacaaggcgtgcgagaacgtcggctacgagttcaaggggcggaagaacgagctgcagtacaagctaccgccggtaaccgagctcgaggacgagatcctgaacagcgtggtcctgcgcgccgtttcccagacccggaaggtgatcaatgccatcatcgacaaatacggcagcccaaccgccatctacatagagaccgcccgcgagctctccaagccctacgacgagcggatgaagatcgagaagcgccagaaggagaacgcggccaacaacgaccagatcaaggagtacatcaaggagactttcggcttcgaccccaagcccttcgacatcgtcaagatgaagctgtggcgggagcagaacggcaagtgcgcctactcaagcaagcccatcccggccgagcgcctgtatgaggagaacttcgtgcaggtcgaccacatcatccccttcagccggtgcttcgacgacagctaccagaacaaggtgctcgtgctgacggacgagaaccagaagaagaaggagcgcacccccttcgagtacttcggggaggacaaggagcggtggcaccagttcgaggagttcgtcaacctgacctataagttcaacacccgcaagaaggagaacctgctcatcaagaacttcaacgaggagaagtccaaggagtggatccagcgcaacatcaacgacacgaagtacatcagcaagttcatgtacaactacatcgccaacaatctgaagttcgcggactccgagagcaagcggaaggtgtacaacatcaacggccaggccacctccatcctgcgccactactggggcctcaagaaggaccgggaggagagcgacaagcaccacgcccaggacgccgtgatcatcgcgtgcgccaccaacaaaaacattaagaaggtctccgactacagccgccggaagctgctttacaagaacaacgagatcatcgacgaggagaccggggagatcatcgacaaaaagtacaacatcgacatctccataaaggagccctggccgaagttccgcgaggaggtggaggcccggatggaggacgccgacaacaacggccagctctacgccctgatcaacgggaacttcacgaactacgacgacgtggacatcacccacatcaagcccatcttcaccagccgcatgcccgagcggaagatcaccggccgcgcgcacaaggatacgatgcggtcgcagaagttcatccagcaggggcagaacttcaccgtcgtgaagaagcccctgaaggccattagcaagcaggagatcgagggcatcatcaacaacccggacttcaagaacctctacctgtcagacaagaagctgtatgacgatatctaccaaaagatgaaggaggcggacttcaaggccgagaaggccttcgcgaacgagtacagaaaatacagcaagaacggcaactcccccatcgtgcggagcataaaggtcgcctccgccggggccaccggcgtgcagctcaagaacggggccatcgcggagaacgccaacatggtgcgcgtcgacgtgttcgagaaggacaacaagaactacctggtgcccatctacgtcagcgacttcgccaagaacgagctgcccaacaaggccatctgcgcgaacaaggacgaaaaggagtggatcgagatgaccgagaagtacaagttcaagttcagcctctaccctaacgacctggtgaagatcaagcggaagaatgagaaggagttctacgcctactactgctccacccaccgcggcacggggaacatcaacctgctcctggtgaacggcgaggcccggaaggacggcgtcgggatcaagaacaccgagatcttcgagaagtaccaggtggacgtgctgggcaacatcagcaaagtcaacaaggagaagcgcgagggggtgaagtga

SEQ ID NO: 7328 - RNA, 3216 nt, synthetic construct
  misc_feature 1..3216: note = Cas9 variant
  source 1..3216: mol_type = other RNA
atggactatcggatcggtcttgacatcgggacgaatagcataggctggtcgatcattgaactcacgacggtccagagcaaacttgacggaaaataccgcctcaaagccgtcggtttgatcgatgccggggtgcgaatgttcgaccgcgcagaagtccccaaaaccggcgccagcctggccctgccccgcagactcgcacggagctcccggcgccgcctgacccgacggtcggcccggaagaaggcgatccgcaacctgctcgtcaaggaagacattctgaaccagatagaactggaccacctataccgcacttccgagttggtcgatatctggcaaatccgggtagagggcctcgagcgccgtcttgggcgccaagagtgggcacggttgctgatccacctcggccaaaagcgggggtacagaagcacgcgcaaggccgaagagggcgccgacacagaagggcgagcggtactttccagcatcaaggaaaaccaggagaccctgaagcaataccggaccgtgggcgagatgtgggccacggacgacaaattcaagggccgggtcagaaacagcaccaacgagttcatcttcaacgttagccgcgacaacctcgaagaagagattcggtttctgttccaacaacagcgcgagctggggtccatgtacgctagcaagctcctggaggagtcttatatggaggtgtggggccaccagctccccttcgccagcggggagtccatcctcaagaacgtgggtacatgcagcttgtacgagaaggagaaacgggccgctaaggccacgtacaccttccaatacttcatggcgctggacaaactcaacaatgtccgcatcttaccctcaatgcggacgctgagcgaggaagaacgcgggcttgccctaaaggcgatgtttgagcgggacaaactgcccaaaaacccgcccaaattcacctattcacacctccgcaaggcgatcaagctggaggaggacgagaccttccagacgatctcctacgacgtggagaagacccttgccaccaacgagagcgcggtgtttgtcaaccttgctgcctactaccaaatcaagaaggtgtgcgacgaacacaacgaaaactacgactacgtggactacaacactatcgggcacgcactaacagtctacaagaccgacgaggacataaacaagtacctggcatccaaaaacaatatagcaaagcgggtgtacgctaacgactttatcgatagcgtgctcaagcactcctacaccaccttcggtcatctgtccctgaaggctctctcccggatcatccccttaatggaggagggggaggttttcgcgaaggccaaggagaaggctggcttcaaggaagagagctacctggaaatcaaatcgaagctcctgacgaatattccggacgcaatcaagaaccccgtagtgatgcggtctctaacccaggcgcgcaaggtaatcaacgctatcatcaagcggatgggggaacagcccgcctccattcagatcgagctggcccgcgagctctcgaaagatgtgtctgagcggaagaagatcacgaacggatttgccgagaatcgcagccgtaatcagttcgctatcaagaccctggaggagaatcacatcacgaacattcggggacaggacattgttaagttcaaactctggcaagagcaagggggtcgttgcgcctactcactaaagcccatcaagctcgaggagctcattagcttcctgaaaaaggagcggcgctatgagcacaacctagacgtggaccacataatcccctattcaaagactttcgacgacagctacaccaacaaggtgttagttttctctgacgagaaccggaagaagggggaccagatcccagccgagtaccttggcatcgggaccaaacgctgggagaagtacaaagagttcgtgatcacgtcaaaattccccgccagcaagaaaaagcggctcttaaaggaacagctcgtggagcgcgaggaattattcatgaaagagcggcacctgaacgacacacgatacgcctcacgatacttcatgaactttctcagggagaatctgttgcggaaggagaccgtcctccacgaaacccagtgggtaacggcggtggccggccgcgtcaccagccacatcaggaaacgactcggttttggaaaggaccgggaggaaactcacctccatcacgccctggacgcaatcatcgtggcctgcacagacaagtggatgatcgactgcgtgacaaactactacaaaagccgcgagggcggaagcataaaacggaaggagatcagattccccagtccatggaacggcttctggcatgacgtccagacgaagctggcacaactaccgcagccagaggtgatcaatgagagcatcagcaaagggaatcctgacgccgtggattacatgctcgtcagccggatgcctcgcaagtctatcaccggcgctgcgcacaaggagacgatcagcaagtggggtgggtacgacgataagggtaaggctttgctggtgaagaaggtggctctgtccgagctcaagttcaaaaacgacgattttccgatgtacaacaaggagacggatccgctcctctatgaggccatcaaaaaccgttacgttgagagcgggagggacgtgaaaagagcattcgccacacccttatacaagccctccaagtccggcaagcggaacgaggtgaagcgcgtcaaggtcatcgcggaaaagaaggccatggtgagagaggtcaacggcgggatcgccgagaatggcggactggtgcgatccgatatcttcctcaaagagaagaagtacgtgatggtcccagtgtataccttcgacaccatcaaacaacaacttcccaacaagtacgtggtcagcggccgggggtacgagcaatggcccgagttgactgcagagcacgtgtttcagttctccgtgtacccttacgagctcgtccacgtaggcacgaacaagggtgacaacagcttctactacttcgcttcccttaacatttcctctaacgtactgaagttctctgagtgcaatcgcccgaccaaggactacatcgagatcgggctcaacagcatcatcctgctagagaagtacgagatcgacgtcctaggcagaatcaccgggcagtccaagaaaggcattcgccagagcttcaagaataacaagtcccagatgaaagagtga

SEQ ID NO: 7329 - RNA, 3219 nt, synthetic construct
  misc_feature 1..3219: note = Cas9 variant
  source 1..3219: mol_type = other RNA
atgagactcgggctcgacatcggcaccaacagcgtcggatggtggctctataagacagacggagaagccgcctcagcacgcatagtcgaagtaatagacgggggagtacgaatattcagcgatgggcgagacccaaaatcaaagacatcactggcggtcgacaggagagtggcccgagcagccagaagacgacgcgacaggtacctccgccgacgagcatctctcatgaagctgctagcccgcacgggactcatgcccgcagatccagtcgaagccaagaaactagaaagactggacccatacgaactacgcagcaccggactcgacgacgcactcccactcacacacttcggaagggccctattccacctaaaccaacggcgaggattcaaatccaaccgcaaaactgaccggggagataacgaaaacggcaaaattcgcgaagcaacagctcgactcgatctggaaatgatgacgtcaggcgccaggagctatggagagttcctccacatgcgccgacaacgggcatccgacccacggcacgtacccagtgtacgaacaagactaagcgtagcagccagagggggaccagatgccaaagcggaagccggctacgacttctacccagacagacaccacctggaggaagagttccacgcactctgggccgcacaagcaacacaccaccaggcactcacagatgacctcagggacctagtattcgagaaaatcttctaccaacgccccctgaaagaaccaaaaataggcctttgccttttcaccgccgaagaaagaatagcgaaagcgcacccactaacacaacgccgagttctattcgaaacaataaatcaactacgagtaacggcggacggaagatcgacaagaccactaaccctggaagaacgagacacgctggtgcatgcactagataacaagaaacccaccaaatcgatgaccagcatgaacatgacactaaaagcacttgcaaaactcctaaaactcagagacggagaaagattcaccctagaaacaggagtaagagaaaacataagctgcgacccggtccgcgcatgcatggcacacccggccaggttcggcccccaatggtcaagcctcgattgggaagcacaatgggacgtcatatcgcgagttcgccaagtacaatccgaaggggagttcatagaactcacagactggctcatacaaggacacgggctagacgccgatcacgccaaagcagtgggaaacgcgcccctacctgaagggtacgctaggctcggattcagtgcaacggaaagaatactggaccaacttaaagcagaagtgtgcacctacagcgacgcggtagctaagtgtgggtggcaccacagcgatcaacgcacgggcgcatgccttgaagtcctcccttactacggcgaggtactcgaccgccacgtcatacccggcacgtacgacgcgacagacgacgaaatcacaagatacggaagaataaccaacccgacagtacacatcggactcaatcaactaaggcgcctagtaaataaaataatcgaggtccacggaaaaccagaccaaatcgtagtagagctcgcacgtgaactcaaacagagcgaaccccaaaagaaggacgccatgaaacggctacgcaacaccaccgcggacgcaatcagaagaagtgaacagttagaacaactcgggcaacccaatacaggccacaacagaatgctccttcgactctgggaggacctcggcccagcaatcggaccgagatgctgcccatacaccggaaaaaccataagcgtaacgatggtattcgacggaagctgcgacgtagaccacatactgccattctcccgcaccctcgacgactcattcgccaacagaaccctgtgcctaaaagaagcaaaccgagaaaaatcggaccgaacaccctgggaagcctggggaggcacagaccaatgggacgatatcgcagccaacctgaaaaatctacccgaaaagaaacgcaaaagattcggaccggacgctatggaatggttcgaaggggagaacgatttcctcgacagggcactcgtcgacacacagtatctcgccaaaatcagcaggatgtacctagacacactgttcacaaaaggaggccacgtatgggtggtccccggccgtatgacagaaatgctccgtagacactggggcctgaacgcactcctcaacgacaaggaccgaggagccgtaaaggcgaaaaaccgcacagaccatcgccaccacgcaatcgacgctgcggtagtagccgctaccgactacaggctcatgcagaaaattagcagagcagccggacaaggagaaaacgcaggacaaagcgcggaactaattgcacgggacacggatgcaccatgggaacactttcgcgccgacatagccagccaactggagaaaatcatagtgagccaccgggccgaccacggccgtatagacgtagaaggacgaaaaaccgggagggactctacagcagggcgcctacacaacgacacggcatacggcgtaatcgacgacctgacagtggcctcaagaacaccgctgatgagcctaaaaccaagcgacatagcaataacagagagagggaaaaacatacgggacccgcaactccaaaacgcactatacgtcgcaacaaagggaaaagagggaaaaatgttcgaacaagccctagtagactttgcgtcaaaagaaggtccctaccaaggcataagacgcgtgagacttgtggaaaccctacaaaaagcagctcgggtagaaataggcaaaaccgaatcaggacaacccctcaaagcgtataaaggagactcaaaccactgctacgaactatggaaactaccggacggaaaaattgtgccccaagtcgtaaccacgtacgaagcccacgcgggaagcgcaccccgcccgcacccagccgcgaaacgtatcctaagagtgttcaagaaagacatggtaaaactgaccaaagacggtgaagaaattgtcggctacgtacaaagcatgcacatcaaaaacggactcttcgtcgcacaacacctagaagccaacgcagacgcaaggaacagagacaaaaccgacccattcaaattccttcaaatgggcgcaggaaccctcgtaaagaccggcctacgacgagtcctcgttgacgaaataggtagactccgagaccccggtccgcccaagctatga

SEQ ID NO: 7330 - RNA, 3225 nt, synthetic construct
  misc_feature 1..3225: note = Cas9 variant
  source 1..3225: mol_type = other RNA
atgcaaaccaaaaacctaccatataccctaggcctagacatcggcatggcgagcgtaggtgcagcactactcctgccagaccaagaacgcatattagcactacacgtcagaactttcgacaaagccgaaacggcaaaagaaggcgaaagcctgaacaaaatccgaagagactctcgactaacaagacgaaggatcaggaggcgagcgcataggctcgtgcgcctcgcgcgacttatgaaaagagtaggactcatagcagacgcaaatcccgaagcctttgcactaccaggagtgtccccctggcacctgagagctgacggattagatcgcctgctcgagccaaaggagtgggcaggagtcctataccacctggtaaaacatagaggattccagagcaacagaaaaagcgaagccaaggccgacgaaaaagcagggcaaatgctcagcggcgtaggccggaaccaggcattgctaaaggaagccggctaccgcacagtcggggaattagccgcccgacatgaggacttcaaagaagcaaaacgcaacaagggaggaagctacagccacacattcgccagagcagacctcaacgctgagctcaaccttctgttcgaacgacaacgagcactaggaagcaggctcgcaagcgcggacttccaggaaaacgtaagagacctcctaatggcgaggcgccccaccctaagcggcgcaaatctactcaagatggttgggaaatgtaccttcgagaaaagcgaagaccgagcgccaaaagccgggtaccgcgccgaacgattcgtctggctaggcaaactcaacaatctcaaaatcgttggatcaggggacgcacgccccctgaccgacgcagagcaccgaatcgtcatagaccttccattcacacaagcaaaactcacctttaagcaggtacgcaaggcactagaacttgaaacccaccaacgcttcaatttactgtcatacaggccagacccgaaagggaaggacaaagatcccgaagaatcaacattcttcgaggccaagagcttccacacactccggaaagcctatgaaggcgccggcctaaagaaagagtggcaacgggacgccctagatcccgacagactagacgcactcgcgtacgcgctaacatgctacaaagatgacactgaatcccgccagtggttagtcgcgcaaggaataggaacaccgatcatcgaagcagtactagccgaatcattcgacaaattcattcacctctcccaaaaagcgctaaaagccatactcccacacatggaagccggacaacgctacgacgacgccgcgaaatcagccggatacgatcactcacaacccgacgccgggaccggcaagagggcaaccctgcccccacccgacaaagatacgatccgcaaccccgttgtctaccgagccctcaatcaggcacgaaaacttgtgaacgccatagtcgctgaatacgggcccccagcagcggtacacatcgaactcgcgcgagacctatcaaaaccaatagacgaaaggcgcgatatcgaaaaagggcaaaaagaatttcaagcactgaaagaaaaactagcagcggccttcgaagaaacattccaccgaaaaccatcaggactagacctattaaaataccgactcttccgcgaacaactggaccaatgcccttattgccaaaaggcacttgtagtagaccgactattcgaacctggttacgcccagatcgaccatgcgctgccctacagcaggagtttcgacgacgggatgaacaacaaagtagtagtccatgtcgcctgcaaccaagacaagggaaacagaacaccatacgagttcctggacggagccggagacagcgaaaggtggcaacgctttgtcgcgtgggtacaaggaaacaaggcgatccgacaagccaaacgcaaccggctcctacgagtaaatttcggaacagacgaagcaaaggagttctcaaaacgaaacctaagtgatacaaggtacatctgcagggaatttaaacgcaccatcgaaacacaattcgcatggcacagcgacgccgaaggaaacgaacgatgcgtcgtactgagcggccagctcacgagcctgctaagggcacggtgggggctaataaaagtacgcgaggacggggacctccatcacgccttagacgtagctgttatagcggcggcgagccggagcctagtcaaaagaatggccgattactcacgcaggaacgaactagagatggtgcgcaatcgctacgtagacccagccaccggcgaggtggtagacgtcgcagccctccgccaaatcgaagaccacttcccaaaaccatggccgctctttcgagaggaactactagcacgcctagcaccggaacccaaattgcaactcacatgcgtctcatcctacgacgaaggcctacgagaaagcatacggccgatccgagtgagccgcgcacccacaaggaggggattaggcgccgcacaccaagagaccatcagaagcctcagagacggcagccagtcagcaatcaagacacccctcagggacttgaaccttaaagacttggaaaacatagtagggttcgaacgcgacaccgcactcatcgacgccataagaaccagacttgaagcattcgggggtgaagggaaaaaggccttcgatgacaaacagccacccctacggaaaccctcgaaagacccggacaaagccccaatcatacgtagtgtaaagttgctcgtcacacaaaaatccggtatccccataaggggaggaatcgcaaacaatggagccatgttaagatccgacattttcacaaaggcgggcaagttttatgccgttccaatctacgtcgccgacgcagtacgcggcgagctcccgcaccgagcagtcgcacaagctaaaccagagctcgagtggccaatgatggacgaaagttaccaattcctattctcactacaccccaacgactggatgactatccggctaaagaatgaggtacgagagggatactacgccggactagaccgggcaaccgggaacataagcctctggctccacgaccgaaaccaaaacgtgggacaaaaagggctactcacgggaaacggcataaaaaccgctctcgcagtggagaagtaccacgtcgacctactaggaaaactacaccgagttcacaaagaagaacgccaacccatacacatcaaaccaggcaagcgatga

SEQ ID NO: 7331 - RNA, 3234 nt, synthetic construct
  misc_feature 1..3234: note = Cas9 variant
  source 1..3234: mol_type = other RNA
atgaagtacagcatcggcctggacattgggatcgcctccgtaggctgggccgtcatcaacgaggacatagagcgcatagaggacctcggggtgcggatctttgacgtggccgagcagcccaagactggcgccagcctgtccaccccgcgtaggttggcccgcagcacgcggaagcgcctccggcgccggcgacaccgggtcgagcgagtgcggaagttcatgattcagaaggggctgctgacccaggtgcagatggagcagctctacgactggaaggacggcgacctggacatctggctggtccgcgtgaacgccctcgagcggaagctgtccgaccgcgagttcgcccggatcctggtgcacttcgcgaagaaccgcggcttccagagcaaccggaagtccgagctccaggaggaggacaacggggctgtcctgagcgccgtgcaggagaacaagcgcctgatggaggagaagggctaccagaccatctccgagatgctcctgtacgacgagaagttcgaggggacgaagcggaacaaaggcggggagtacacgcacgtggtcgcccgcagcgacctgaagcgggagatccagctcatctttgagaagcagcgcgcttacggccacgccttcgccaccatggagaacgaggacaaattcctgcagatatggtccagccagcgcccctttgcaaccaaagacgacatagccaagaagatcggcaactgcaccttcgagcccaaggagaaacgggctcccaagtccacgtacaccttcgaacgcttccgggccctagacaagctcaaccgcctgcggatcctgagcgggacctccccggcgcgcagcctgacccaggaggagcgggacttaatcctgaactccctgttcagcaagaaggaggtgaagtacaaggagctgcgcaagctgctcaagttgaacgacgagcaacggttcaatgagatattctacgaccccaacgagaagatcgagaagaacgagaaccgaacattcctgtctctcgagagccagtacaagatccgaaagatcctgcagaagatcgagggcaagagcctgaacgatacctaccgccctgtggacctagacaccatcgcctacgcgctgaccgtcttcaaagacgaccaggacatccgggactacctgcagaaccagtacgtggcgagtaacgggaagaaggagctcaacctggccaatcgcaagtacaacgacgagctgattgaggagctcctgcacctcagcttcacgaagttcggccacctctccctgaaggccttaaggaacatcctccccttcatggagcagggcatcccctaccaccaggcctgcgagaaggccggataccagttcaacaagaaggtgaaccgcgagaagcagaagctgctgccgcccgtccccgccaaggacatcgtgaaccccgtggtcatccggagcctgtcccaagtgcgcaaggtgatcaacggcataatcaagcgctacgggagcccctccagcatctacatcgagctcgcccgggagatgggccgcggctacaaggagcggaaggacctggagaagcagtacaacaagaaccgccagatgaacgagggcgccaagaaacacatcctggagctcaggcccgagttcggcgacccccgcgggcacgacattctgaagtataaactgtggcaggagcaagactgccggtgcgcatactccttcaagagcatcccgatcaagcagctgttcgagatcggctacgccgaggtcgatcacatcatcccctactcccgctccttcgacgactccaacaacaacaaggttctcgtcctcgcggccgagaaccagaacaagcagaaccggaccccttacgagtggttcgggcacgacgagacgaagtggcaggagttcaccagcctcgtgacgaccatgaaggtgtccaagaagaagaagtccctgctactcaagaagaacttcgatgaggagcaggccgaggagttccgcagccggcacctgaacgacactcgctacatcacccggtacatcaagacgttcatcgaggacaacctgcagttccgcatcgaggagggcaagaagacctacgtccacaccgtgaacggggcctacaccagcctcatgcggaagcgctggggcttcaacaagaaccggcaagagaacgcactgcaccacgccctggacgccgtgatcgtcgccgtatccctccccttcaagcacaaagttcgcgcctacttcaagcgtcgcgaggagtacgcgcacaaccagctgaagcgggagggcgagttcttccctgagccctggcccgggtttatccacgagctagagatccgcatgatgcaggacagcgagaacatcaagctcgccatggaaagcctcaacctgaaaacgtacgacgaatcgttcattaaggagctcaagcccatctttgtcagccgaatgccgaaacgggccatgaagggccagatccacgaagagaccctgaagcgagtgcgggggcgcaccgacgatggctacatccggaccgtgaagaaggtcaagctagaccagatccccttcgacaagaacggggacttccccatgttcggcaaggagacggacatgaaaacctatgaggcaatcaagtcccgctacctcgagagcggcaaagacaagaagaaggccttcaacacgcccctgtacaagccggcgaagaatcccgagaacgcccccattatccggtccatcaagatcgaggagaaggcaaaccgcgtggtgatgctggacgagaagaccgccgccgacaatgcgagcatcgtccggaccgaggtgttccgccacaaggagaccgggaactacttcttaaccccggtgtacgtcgccgacgtgctggccaagaaagtgcccgaccggctcatcaccaccaagaagccctactctgagtggcgcaagatcacggatgagtacgagttcctcttcagcctgtaccccaacgacctgatccgggttaagatgcctaaggaaaaggagaccaagacccataccggtgagaagcacgtgtggcaggaaaatttcatgtacttcaagggcgtgcactccggcagcgccggcgtccgcatgatcgaccacatgaactccttcgaggacgaaatcggggtgcggaagctcgtggtcttcgagaaataccaggtggaccccctgggccgtatgaacaaggtgcacggtgaaaagcggcacggcatctga

SEQ ID NO: 7332 - RNA, 3234 nt, synthetic construct
  misc_feature 1..3234: note = Cas9 variant
  source 1..3234: mol_type = other RNA
atgaaatactcaatcggactcgacataggaatagcaagcgtcggctgggcagtcataaacgaggacatagaacgtatcgaagacctcggggtccggatcttcgacgtagccgagcaacccaagacaggtgcatctctatccacgccccgccgactcgctcggtccacccgcaagcgcctccgaagacgcagacacagggtcgagagagttcgcaagttcatgatccagaaaggtctactcacacaagtccagatggaacagctgtacgactggaaggacggcgacctagacatatggctagtaagagtaaatgcactagagcgaaaactcagcgaccgcgagttcgcccgcatcctcgtccacttcgccaagaacaggggctttcagtccaaccgcaaaagcgaacttcaagaagaagataacggggccgtgctcagcgccgtccaggaaaacaaacgacttatggaagagaaaggctaccaaaccatcagcgaaatgctcttgtacgacgagaaattcgagggcacaaaacgaaacaagggtggcgaatacacacacgttgtcgcacgaagcgacctaaaacgcgaaatccaactgatattcgaaaaacagcgtgcctacggacacgcatttgcgaccatggagaacgaagacaaattcctccaaatctggtcaagccaaaggcccttcgcaaccaaagacgatatagccaagaaaatagggaattgcacattcgagcccaaagaaaagcgcgcccccaagtcgacttacacattcgaacgtttccgggcactcgacaaactaaacaggctacgcatactcagcggaacctcccccgcacgctccctcacccaagaggagcgagatcttatcctgaacagcctcttctcaaagaaagaagtaaaatacaaagaattacgaaaactcctgaaactcaacgacgaacaacgattcaacgaaatcttctacgacccgaacgaaaagatcgagaaaaacgaaaacagaaccttcctatccctcgagtcccagtacaaaatacgcaaaatcctccagaaaatagaaggtaaaagtctaaacgacacttaccgccctgtcgacctagacaccatcgcgtatgcactcaccgtcttcaaggatgaccaagatatacgggattatctacagaaccaatacgtcgcctccaacggcaagaaagaactgaacctcgcaaacaggaagtacaacgatgaactcatagaagaactactccacctcagcttcacaaagttcggacacctatccttgaaggcactccgtaacatactaccattcatggaacaaggaatcccctaccaccaggcgtgcgaaaaagccggctaccagttcaacaagaaagtcaaccgagagaaacaaaaactgctcccgcccgtacccgccaaagacatcgtcaacccagtcgtcatccgatccctttcccaagtccgaaaagtaataaacggaatcattaaacgctacggttcaccctcctccatctacatcgaactagcgcgagagatggggcgtggatacaaagagcggaaggacctggaaaaacaatacaacaaaaaccgacaaatgaacgaaggagccaagaaacacatactcgaactccgacccgagttcggagacccacgggggcatgacatcctcaaatacaaactctggcaggaacaggactgccgctgcgcctactcattcaagtccatccccatcaaacaactcttcgaaatcggatacgcagaagtggaccacatcataccttactcccggagcttcgacgactcaaataacaataaagttttagtactagcagccgaaaaccaaaacaagcaaaaccggacgccttacgaatggttcggacacgacgaaaccaaatggcaagagttcaccagccttgtcacgaccatgaaagtcagcaaaaagaagaaatcactcctactaaagaaaaacttcgacgaggaacaagcggaggagttcaggagtcggcacctaaacgacaccaggtacatcacccggtacataaaaacgttcattgaagacaacttacagttccgcatggaagagggcaagaaacaatatgtacacaccgtcaacggagcgtacacctccttaatgcggaaaagatggggtttcaacaaaaaccgccaagaaaacgacctccaccacgccctcgacgccgtgattgtggcggttagcctgcccttcaaacacaaagtaagtgcatacttcaaacgccgagaagaatacgcccacaaccaactgaaacgagagggcgagttcttccccgaaccctggccgggattcatccacgaactcgaaatccggatgatgcaagactcagaaaacatcaaactcgctatggaaagcctgaacctgaaaacgtatgacgagtccttcataaaagaactgaaaccaatcttcgtcagcaggatgcccaaacgcgccatgcgaggacagatacacgaagagacactgaaacgagtcagaggaagaacagacgacggatatatacgcaccgtcaagaaagtcaaactcgatcaaattcccttcgacaaaaacggcgacttcccaatgttcggcaaagaaacagatatgaaaacatacgaagccatcaaatccagatacctcgaatccgggaaagacaagaagaaagcgttcaacacacccctgtacaaacccgccaaaaacccggaaaacgcccccattatccggagcataaaaatagaagagaaagcaaaccgtgtagtgatgctcgacgagaaaaccgccgcagacaacgcatcaatagtgcgcacagaagtcttccgtcataaagaaaccggcaactacttcctcacgccagtctacgtcgccgacgtactagccaagaaagtccccgaccgtctcatcacaaccaaaaagccgtactcagaatggagaaaaatcaccgacgaatacgagttcctattcagcctctacccaaacgacctgatacgagtgaagatgcctaaggaaaaaggcacaaagacccacacaggggaaaaacacgtatggcaagaaaacttcatgtatttcaaaggggtccacagtggatccgccggcgtccggatgatcgatcacatgaacagcttcgaagatgaaatcggcgtgcgcaagctagtcgtgttcgagaaataccaggtggacccgctaggtagaatgaacaaagtccacggcgaaaaacggcacggtatttga

SEQ ID NO: 7333 - RNA, 3234 nt, synthetic construct
  misc_feature 1..3234: note = Cas9 variant
  source 1..3234: mol_type = other RNA
atgcagcagaaaccacaaagatacatcctgggactagacctaggaatcgcctctgtaggttgggcgtgcgtctgggccgacgaaaacgaacaccctacaggcctcctcgactgcggagtcaggacattcgaacgagcagaagtacccaagaccggtgacagcctagccttggcgcgaagacaagcacgaagcgtcagaagactgatacgaagacgagcgcaccgactgctcagactcaggcggctattaaaaagagaaggcgtactactatccgcagacttcaacgagaacggcctggtaagaggactaccaatcgacgcctgggccctccgcgtagcaggactcgacaggaaactaagcaacaaggaatgggctgcggtcctgctccacctcgtcaaacaccgcggctacctatcccagagaaagaacgagacccaatcaaaagacaaagaactgggaagactacttgcaggagtcaacggaaaccgagaggcactccagaatcgttccgatgaataccgcaccgccgccgagctggcagtgaagaaattcgccgcagaaaacaacggatcactacgcaacaaaggaggcgactacagccacaccttcgaccgcaaagacctacaaagagaactacacctcttgttcgaaagacaacgagccctggacaacccattcacatcatcggaaatggaggctgcagtagacgaactactaatgaagcagcgctcagccctacaaggagaagccgtcctgaaaatgcttggccggtgcacatttgaacccagcgagtacaaagccgcaaagaacacctactccgccgaacgattcgtctggctaacaaagctaaacaacctgagaatacaatacaacggtgaagagagagcgctaagcgaggcggaacgacgcctcctactagacgagccctaccaaaaagcgaaactcacttacaagcaagtgcgaactatactcgaactacccgaaagcgccgtctttaaaggcctcagatacggtcacggggaggacggactaaaagcggaaagcggtacactgatggaaatgaaagcgtaccacgcagtccgaaaagccctgaaagacgcgggcctggaaggcgaatgggagaacaggatcagaaacccagagctcctggacgccataggcacagcattctcactctacaaaaccgacgaagacatacgagccaacttagcggcattccggctcagcgagaacgtactcgaagcactactggcaggattgaacttcgataagttcgtgcacctgtcgctaaaagcactagcaaaaatcctcccactaatggaacaaggaatgagatacgacgaagcgtgcaaggaagcctatggggaccattacggggcgaaagaacaagaggaccaccgtctactcccgcccttcgtagctgacgacatcagaaacccagtcgtctttagaacactgactcaagcccgcaaaatcgtgaatgagatagtccggaggtacggcagcccattgcgagtacacatagagacaggcagagaagtaggcaagagcttcagcgacagaaaagaaatagaaaagcgacaagaagagaacaggaaggaaagagagagagcagcggcccacttcaaagaactatttccaaacttcgcgggggagcccaaagcccaggatatactaaaattgagattatacgagcagcagcatggcaagtgcctgtacagcggaaaagaaatagacctcagacgcttaccggagaaaggctacgtcgaaatcgaccacgccctgcccttcagcaggacttgggacgatagcttcaacaacaaagttctagtactcgggaaagaaaaccaagacaaaagaaatcggacaccgtacgaatacctagacggcaaaggaaacagcggagcgtggcgcgccttcgccgaaagggtctcaggatgtcgatttccctacgcaaagaagcaaagactacttacacaaaagctagacgagaaaacagaacaaggcttcctagaaagaaatctgaatgacaccaggtacgtggcgagattcctgtgccaattcatagaggagaaaatgcacctagaaggcgccggaaagaaaagagtattcgcaagcaacgggcaaataacggcgctactgcgcggattctgggggctaaagaaagtaagagaggagaacgaccgccaccacgcactagacgccgtcgtagtcgcatgcagctcagtatcaatgcagcagaaaataacccggcacttccgctacagagaagaattagaacatatagaccgagaaaccggagaagtaatccatggattcccgcaaccctgggaatttttccgacaggaagtgatgacacgggtcttctcagacgacccagtaagcgaactcgccgaaaaactggatagtagacccgaagcagtacacgagttcgtaaccccactctttgtctcacgagctccacaccgcaaagtcacaggacaaggacacctcgaaacgatacgcagcgccaaaagactcgacgagaaaatatccgtagtaaagctgccgctcacgcagctaaagaccaaagatatcgaacgaatcgtgggctacccaaacagagagcccgcgctatacgacgcactcgcggcccgcctcgcagcgttcaaagacgaccccgcaaaggcattcagcgagccattctacaaaacagggaaagacggcaaatgcggcgttctagtaaaagcggtgcgcgtagaaaacgtacaaaagtctggtttgcttgtccgcaaagacgagagcggcaagatgcagggtgtcgcagacaacgccacgatggtacgagtcgacgtattcggcaagaacggcaaaaactacctggtacccgtctacgcctggcaagtcgaaaaaggagaattgccgaacagagccgtagtcgcatacgcagatgaagaagactgggacgagatggacgactccttcgagttcaaattcagcctatatccgaacgacctagtcgaagtcgtgacaaagaaagacaaatttttcgggtactacagcggcttcaacagagccacgggagcaataaacatcaaagaacacgacctcagcaaatcaaaagtcaaaaacggcgtctacgaaggtataggagtgaaaacggcccagagcttccaaaaataccaagttgatacactgggcaagacaatacgtctatgcaaaccagagaaaagaatggggttcaaaaagaaatga

SEQ ID NO: 7334 - RNA, 3237 nt, synthetic construct
  misc_feature 1..3237: note = Cas9 variant
  source 1..3237: mol_type = other RNA
atgcgctacgtgctgggcctcgacatcgggatcgccagctgcggctgggccgtcatcaaccaggagaaggagcggatcgaggacctgggggtgcgcatcttcgacaaggcggagaaccccaaggacggcaagtccctggccgccccgcggcgcgacgcccggagcacccgccggaccctccgccggaagaagcaccgcatgcagcggatcaaggtgctgctggtcaagcacgggcttctgtccaagacggagctggaccacctctacgagtcagccaccgaggtggacgtgtggaacctgcgcctggacgcgctcgagcggaaactgtaccccaaggagtttgcccgcatcctgattcacctagccaagcggagaggcttcaagtccaaccggaaggagaccaccctgagcgagaacggccagatcctagagtccataagcgagaaccagcagatcatggagaaacagaactacaggacggtcggggagatgatcctcaaggacaagaagttcgagaaccacaagcggaacaagaacggcacctacgtggggaccgtgacccgccagcagctgcaagacgagatccagatgatcttccacgcccagcggctgtacaagaacgactacgcgacggaggagttcgagtccagctacctcgagatatgggcctcccaacgcccctacgccagcaaggaccagatcgagaagatgatcggctactgcaccctggagcccaaggagaagcgcgccccgaaggcctcctggagcttccagtacttcgtcgcgctgcagaccatcaacaacctccggctgatctccaaggaccgcatcgaggagctgagcttcgaggagaagaagcagatcatgaacctcgccctggagaagtccatagtgaagtacatcgacatcaggaaactactcagcgtgcccaatgagttccagttcaactccctgtcgtacagcgccgacaccgtcgacacggccgtggagtcccgtaagtgcatcgagctgaaggagtaccacagcatcaacaaggtgtacaagcagatctacggggagaacgccctcaacctgctgcccaaatactatgataccatagcgtacggcctcaccatcttcaaggacgacaaggacatcctggagtacctgcagaacaagtacgtcaacgccaagggcaagcccatctccaacttcgccaacaagacttacgacgacacgttcatccaagccctcctgaacctgaacttcaccaagatggggcacctcagcttcaaggccctgaagaacatcatcccgttcctggaggagggcctctcctacgacaaggcgtgcgagaaggccgggtacaacttcaaggggaccagctacaccgagcagacgaagtacctgcccgtgatcccccagaacaccaaccccgtggtccaccgggcactgtcccaaacccgcaaggtgatcaacgccataatcaagaagtacggcagcccgaacgccatccacatcgagaccgcgcgggagctctccaagacgttccaagagcgcaaggagatcgacagcatgtaccaggacaactccaagaagaacgagcacgccatccacaagctgaaggagctggggaacatcaaccccagcggcatcaacatcgtgaagttcaagctgtggaacgagcaggacgggcggtgcatgtactccggcaagtacatcgagcctcaccgcctctttgaggaagggtacaccgaggtcgaccacatcctgccctacagccggtccctggacgactcatacaacaacaagaccctcaccctgggcacggagaaccagcgcaagggcaacaagatcccgtacgagtacatggggaatacctccatctggaacgacttcgagacccgggtgcagagcaacaagaagatcaacaagaagaagcagcagaagctgctcctgcagcacttctcctacgcccgcgagcaggagttcatcgagcggaacctgaacgacacccgctacgccacgatctacctcagcagcctgatccagcagcacctgattttctccgagagctcccggaagaagaaggtgcacaccgtcagcggcatcatcacctcccacctccgcagccggtgggggttcaacaaggaccgcaaggagggccacatccaccacgcgctggacgccgtgatcgttgccgtgacctccgaccacatgatccagcgcgtgacgaagtactacaagctgaaggagctcaaccggaacctgcaggccaagcgcatgcccttccccgagccctgggaggggttccggctggagctcgaggcccgcatcagcccgaacacccagcagtacctgaaaggcctgcggttcaagaactacgcggacgtcaacctctccgagatcaagagcatcttcgtgtcccgcatgcccaagcacagtatcacgggcgagctgcaccaggagaccatccggaagttcatcgggtacaacgagaagggcaaggtgctgaccgccatcaagacgaagctcgaggacatccccttcgacgccaacggggacttccccatgtacggcaaggagtccgacctgtacacctataacgccatcaaggagcgctacctgagccacaagaaggacaaacggaagtccttccaggagccgctctacaagcccaccaagagcgggggcatcggccccctgatcaagtccatcaagatcatggacacccgcacgatcgtcaaccccgtgaaccaggggaagggcgtggtctacaacagcaagatcgcccggaccgacgtgttcaagaaggaggagaagtactacctgatcccgatctacactatcgacctcatgaagaacatcctgccccagaaggcgatcaccgccgggaagggatacgaggactggacgaccatcgaccccagcttcaccttcctgttctccctcttcccgaacgacctgattcagatcgtgcccagcaaaaacaagaccatcaaggcccggacgacagtctcgaagaaggaggtgctcctcccctcactgaccggctacttcaagggggtgcactccggcaccgccgggatcactgtcgagacccacgacggcagcgtgatcgctaatgtggggtccaagcagctgctcctgatcgagaagtaccaggtcgacgtgctcggtaactacaccaagatcaaggaggagaagcggatcggcctcaccacgtacaacgacaacaagaagatcgcggcgtgctga

SEQ ID NO: 7335 - RNA, 3237 nt, synthetic construct
  misc_feature 1..3237: note = Cas9 variant
  source 1..3237: mol_type = other RNA
atgaaacaacaaccacagcgatacatcctaggcctagatctcgggatcgcctctgtcggatgggccctcatcctagtagacgaagaaggtaacccaatcggactcctcgactgcggagtccgcaccttcgaacgcgctgaggtaccaaaaactggcgacagcctcgcactggcaagacggcaggcacgatccgtcaggcgcctaattcggcgtcgcgcacaccgactcctgcgactccgacgcctactaaaacgagaaggcgtcctgtctgccgcagatttcaactccgacggactccccaacctacctatagacacctggcaactacgagtagcaggactagagcggaaactcaccaaccaggaatgggcggccgtcctcctgcatctagtgaaacatcggggctacctaagccaaagaaaatccgagactcaaactgaaaataaagaactaggctgcctactcgcaagcgtagctaaaaactccaaactactctcagaaaacgcaaatcaatacaggacccctgccgaactagcagtgaggctattcgccgagcaaagcggccatctgcgaaacaaaggcggcgactacacacacacattcaatagactcgatctccaaaaagaattacacctactattcgaacaacaacgaaccttcggcaacccattcgcaagtgcggaactacaatcaaaagtcgacggacttctaatgatgcaaaggagcgccctacaaggagaggccgtcctcaagatgctaggcaaatgcacgttcgaacccagtgaatacaaagcagcgaaacacacatacagcgcggaacgcttcatttggctcacgaaactcaacaacctacgtatactcgagaacggaaccgaacgcgccctcaacgaagcagaaagaaaactactcctagatgaaccctataaaaaggccaaactaacatactcacaagcccgaaaactattagacatgtcccacgatgccacattcaagggcctacgctacggcaaagactcagaaggcctaaacgccgaaaacggagcactaatggaaatgaaagcctaccacaaaataagaaccgtcctcgacaaagctggcctcaagggcgagtgggaaaaccgcatccgcaaccccgaaatcctagacaaaatcggaacagccttcagcctctacaagaccgatgaagacatacaggcggccctagccgacctccgattaccagaaaacgtcctaaacgcattactagcaggcctgaacttcgacaaattcatccaactgtcactcaaggcgctaagcaacataatgccactgatggaacgaggcatccgctacgacgaggcttgcaaagaagtctacggtgaccacagggccctagccgaaagcaaaaaccaaatgctactcccaccaatcccagcaaatgaaattcgcaacccagtagtactccgaacactcacgcaaactcggaaggtgatcaatgcaataatccgacgatacggatcaccacaacgcgtacacatcgagaccgcccgtgaacttggaaagtcctttaaggacagaaaagaaatcgagaaaaggcaggaagaaaacaggaaggagagagaacgcgcggccgagcacttcaaagaactcttcccacacttcgcaggagaaccaaaaggtggcgacatactcaagctacgactctacgaacagcagcagggcaagtgcctatacagctcaatcccaatcgacctaggcagactcaatgaaaagggctacgtggaaatcgatcacgcactccccttcagcagaacttgggacgactcattcaacaacaaagtactcgtcctcggatccgagaaccaaaagaaacgcaaccaaacaccctacgaatacctagacggcgccagcaactcccaaagatggagagagttccaagcacgactgcaaggatgccgattttcgtacgcaaagaaacaacgtatacaaaccgcaaaactagactccaaaaccgaacaagggttcctcgaacgcaacctaaacgacacccgatacatagcgagattcctctgcggattcatcgaagaaaacctacatctgcaaggggagggcaaaaggcgagtcttcgcctcaaatggacagatcacggcgctcctacgtggcctctggggcctcaagaaagtcagggaagaaaacgaccgacaccacgcgcttgacgccatcgtggtcgcctgtagcacagtcagcatgcaacagaaaatcacaaaggcaatgcaacgacgcgaaaccctcgagacggtggataccgaaacaggagaagtcaagaccaggataccgcagccctgggacttcttccgccaagaagtcatgatgagagtcttctcagacaccccacacgaggaactcgcagaaaaactgtccggacgacccgaagcactgcacgacttcgtgagcccactattcgttagcagggcgccaaaccgtaaaatgaccggacaaggacacctagaaaccgtaaaaagcgcaaaaaggctgtcagagaacataagcgtagtacgaaaacccctcacggcgctaaaactaaaggacatagaaaatatcgtcggttaccccgacagagaaccagcactataccaggcgttacgcgaacgcctacaagcatacaaagacgaccccgtgaaagcctttgcagagcccttctacaaaccagccaaaaatggcggtcaaggcagcctagtaaaagcggtccgcgttaaggacgtccagaaaaccggggtcatggtcagaaaggacaggggaggaatagcccggggaatcgccgacaatgcaaccatggtccgggtggacgttttcggaaagaaaggtaaaaactacctcgtccctgtctacgcgtggcaggtcgccaaagggatcctcccgaacagggccgtggtagcctacgcagacgaagccgactgggacgaaatggacgactcctatgagttcaagttcaccctatacccaaacgacctcgtagaaatcatatccaagaaaggccgaatcttcgggtactacagcggcctcaacagggccaccggggcaattgacataaaggaacacgacctgtcgaaagaaaaggcaaagaacggaatccaccagtctgttggcgtaaagaccgtactcagcttccagaaatatcaagtcgaccccctaggaaaagaaatatgcctatgcaaagtcgaaaaacaccccgaactcaacagcaaaaagaagaaatga

SEQ ID NO: 7336 - RNA, 3237 nt, synthetic construct
  misc_feature 1..3237: note = Cas9 variant
  source 1..3237: mol_type = other RNA
atgggttacctaatcggactggacatcggtattacctctgtaggatatgccgtccttcaaacagattttaaaggcaacccatataagatcctactcatgaatacggtcatattcccagtcgccgaggcccctaagaccggcgagagcttagccgcccccgtccggcaaaaacgcagctcccgccgtaccaaccgccgtacaaagttccggaaactcagagtccaaaaactattcgtccgcttcggccttctcgaaagcgccgacgtagccaccttcttaaaccaaaaggttccccatcaagatatttggcagctacgcaaggatgcactaaatcggaagctatcaaaccgcgaactattcgaaatcctctacttcttcgtaggccatcgaggtttcaaatccaaccgtcgctcagaagtgacaggtaaacagcccaaagacaaccaggttgtcctcacttccatccacgacaggggtaacaccctcaacgacttcgactccctcggagaaatgatgcaagaacttcccgagttcaaaactataaaacacaacaaggcctaccgaccagacaacaccatatacccccttcgagcctggatcgagcacgaactctccgccattttctccgtccaacaaaagaacaaccgccaaatcacagacaacttcataacacaatacctcgacatattccgttcgcaacgagacttcgatcaaggaccggccgccccaagccgcttcggaggcaacatgatagagcgtatggtcggcccagactccctcgatgcacacgaaaaacgcgccgccaaattgacaaacacgttctttcgatttaacttcctctcgaccctcaacaacctaaaaatccaactcaccctaggcgccgagttccacccgctgacgacaccccagcgagaaatcgttttacaggcggcaacactcaaatcactaaactacaagcaaatccgacataaactgcaactgccagactcagcccggtttaacctagttccctaccagtctaacgaagacccaataaaaaccgaatcgaaacactacctatttaaacgcaaggccctcactcaaatagaagccgtcaccgacaaccctcaacttatcgacaaaatcggcacaatcctggcatactttaaaggcgacaaaaccaggcaagaaaaactttccgccctcaacttatcacgagcggaaatcaaacaactccttcccataaaccagcccggattcggaaacctgagcctaaagacaatgcacaaaatactcccttacctggagcaaggccacctctaccacgaggccgcccaattagccggctatgacttccagaacaatctcgtcgaccgccaatacctccgcgacaaccttaaaaacccggtcgtcaatcgcgcgatcggcaaaacaatcaaagtcgtcaacgctatcataaagaaatacggcgatcctgacgccatccacatagaactgacacgagaaatcaaacactctcacgaggaacgtcagaaaattgcaaggcaaatgaacacaaacatggaccaaaacgataaagtagcagagcacctccgggagaacggcataccagtcaatgggcaaaacatcataaaatccaagctcttttacgaacaaaaaggcatcgacctatactccggccaacaaattaacgaacaagatctatacacagaggaccattaccaagttgaccacatcatcccctactccatctcctttaacgacagcttcaccaacaaaacggtaacccgaaccagtaataaccaaaacaaagccaaccgcctacctctagagtacctctctgaagaaaagcaagacgcgtttcgcgctcgggtaatgagcaacatctccaactacagaaaaaggcaaaacctcctcaaggaaggcatcacagaagacaaccgccaacagtggaagacacggaatataaacgacaccggttacatcaaccgcctgctttcacagtacctccgcaacaatgttcaattcaccaagaaaagccacaatcccgtattcaccgttaacggggccacgacagcttacatccgcaaacgttacggcatcatcaaaaaccgccaggccaccgaccttcatcacgccgtcgatgccgttatcataggctgcatctcgaacaccttcgtaagccggctcgccaaatactccgaggcccaagaagccagataccacaaacagctatggcaaatcacccaatacagacaggaacacaaagacctatccacaatcgaataccaggagctaatcaaacaattccccctcccctggccagacttccggcacgaactgatggcccgcctctccacggaccctgcgaaaatgatggcacaccacacatgggaacactacacggacgaggaaatttcgcaactaaaacccgcattcgtaatacgctccgccaaccacaaagtaacaggcagtgcccacgacgacaccatctactccaaaaagctatacgaccaacgaggggtcggacttctacgaacctcactccaaaacctcaagtacgacagcaagaaagatggcatcaaaaactacgaacgactcaaagacggctccaactcgctagtctatgactccctcctccgcgccttgaaagaacacgacggcaacgctaagaaagcattccccgacaaccaactccttatatcaactggcaaccatcaacaaatcataacccatgtgaaaaccgtcaagaaaataactcaccccatagaggtcaatcgagacacggccatagcaataggcggccgaatgatccgggtcgacatcttcaaacaagccaaagcacaaaaactcattggcatacccgtctacgtaaatgacaccgtcaaacctacactccccaaccgtgcgtgcacgagcggcaaacgctactccgactggtaccaactaacacgccaagaccaattcctctgctccctagtatccaacgacctcgtcctagtggaaacagccagcccgctcaaagtcaccaacaatatcaccaacgaagaagtccaaacaacccaactactctgctacttcagctcattcaacatcgccaacgcccaaatcaacttccactccataaacaacgactcatcaatcaaccccatagtccttaacaaagttacctacctgaccaaataccaactagactacctgggaaattactttcccgtcaaacacgaaagcaggaaaacatttaaccgcaaacgatga

SEQ ID NO: 7337 - RNA, 3237 nt, synthetic construct
  misc_feature 1..3237: note = Cas9 variant
  source 1..3237: mol_type = other RNA
atgcacacacggttggccctcgacataggaacaacgtccataggatggatcttatatgaactcgtgaatgggcaaccagccagtattctagacggcggaacgcgcatattcagtgacggccgtgaggcaaaaacaggacactcactagcagtaggccgacgaacagcacgagggatgagaagacggagagaccgctatctgcgccgacgagccgccctaatgaaacgcctagcagcaataggactcatgccggagtcaccagaagcggcggcccaactagccacgctggacccatacgaactccgtgcacgagggctcgaccacccactcccacccgaacacctcggcagagcactgtttcatctaaaccagcggcgaggattcaaaagcaacagacgcactgacaaaggaaacaacgaaggaggaatgatagcagatgcctccgcaagactagaacaagcaatgatggccgccggagcaagatcctacggagagttcctacataaaagacgcgctgaagccacagcccccagagcaacccccgcggtaagaacccgcatcaatccccacctaacaggagaggacggcaaagaacagcctgggtacgacttctaccctgaccgaaagcacttggaggacgagttccacagactatgggaagcacaagctcgccacaacccagaccttacacccgccatgggtgacctgctctttcaaacaatatttcaccagcgacctctcaaagcaccagccgtcggtcgttgcctcttcctagacgaacccagactacctaaagcgcatccgctaacacagcagcgcaccctatacgaaaccgttaacatgctccgcatcgccccaccaggccaacccaaacgacggctgtcacgcgtacaacgcgaccaaatcgtacacgctcttaacaaccggaagatcttagcctccccaggcaaaaacgtattaacacttgccgcaataggaaagctcctcaaattaagacccggagaagcattcagcctagacacagccaaccgtgacgccatcgcctgcgacccagtccgaatgagcctcgcctacgaaggacgcttcggccctcaatggtccgcactatcagtagaaagccagtgggaactgattcaacggttaagagacgatcaggacggcgcagcgctagtcgactggataatggaccgatacggcttcgatagagacagagcacgagcaatagcagacgcccctctcccagaaggattcggcagactaggggagacagctactcgcgccgtcctagccgtcttaataggcggaacaacagaacaggaggtccttacctattccgaagccgtggcagcatgcggatgggaccactcaaggctaggcacgggagaggtcctagacaggctaccatactatgggcaggtactggacagacacgtcctgcccggaacagggcgcccggaagacgacgaaataacccgcttcgggcgtatcaccaacccaacagtccacatcggcctaggccaagtgaagcgcctagtcaacaaagtaatcgacgcctgggggcgaccacacgaaatggtagtagaactagccagagacctaaagatgtccgaagaccagaaacgcaatctagccaaagtaaacgcccagaatcaacgcgcagcagaaatgcgaagcgctaagctaataggcgacctaaagatagaagataatggtagaaaccggggcatcttacgcgtgtgggaggagtccgccgccgacgtcctacaccgatgctgcccctacacaggagcacagataagcgcatccatgctgttcgacggatcatgcgacatcgaccacatcttaccgtacagccgaaccctagacgacggattcaacaatcgcgtaatttgcctaaaaagcgcaaatcgagagaaaagaaatctaaccccatgggaagcgtggggaaacacaccaaaatgggcggcaatagaagcaaacctcaaaaacctacccccggccaaagcatggcgcttcgcccctgacgcgatgctgaggtatgaaggagaacgagatttcaccgcccgagccctagtggacacccaatacctctctcgactagcgagagaatatcttgaatgcctttacgcggaagacatagaccccggaccacactcagggaagaaaccccgtaggcccatctgggtcgtaaccggaaaactcaccgagctactacgaagacactggggactcaacagcctcctcccggacgcccaccgaggtaccgccaaggccaaaaaccgtctagaccacagacatcacatgatagacgcagcagtcgtaggcgcaaccgatcacgccacagtacaacgaatcgcaaacatggcaaagggaaacgtcgaaaacggtctcgaagacctagccggcaccatactacccccatggcccggcctacgtgacgacctaaaagcccgactagaacgcacaatagtatcacatcgcggaaaccacggcgcaatcgaccccgcagcccgaaagcagggacgcgataccacatcaggccaactccacaacgacacggcatacggacttaccggcgaaaccctcaaaggcgtccccctggtcgtcaaccggaagcccatcgacatgctaacgcccgccatgatagacaaaatcagggacccacacctatccagatggctaaccgctgtaaccaaagggaaagaaggaaaagacttcaaagcagccgtcgaggcattccgagcacaccccggcccctatagagggatcagacgagtcagactcatcgagccagtagaagtaatacgcataaaagatagaaacggacgcccctacaaaggctacaaaggtgatagtaaccaatgctacgaggtttggtgcctccccgacagaactctcacccaccacgtcgtctcaacattcgccgcccaccaaggacaaaccgggaaaccccacccagccgcgaaacgcctagcaagactatacaaaggagacatggtccgactcgaccgcagcaagtttggatccgtcatcgcgacagtcgagaaattcgacagaaacggccaactagaactcgtccctcacaacgaagggaacgccgaccaacgctaccgcaaagacaaatcagactccgttttcatcagactacgagcagccacattcatcgcgagcggcgcccgacgcgtgatagttgacgaaatgggacgcataagggaccccgggcccggcaagcattga

SEQ ID NO: 7338 - RNA, 3240 nt, synthetic construct
  misc_feature 1..3240: note = Cas9 variant
  source 1..3240: mol_type = other RNA
atgaagtacggcatcgggcttgactgcggcatcaacagcgtggggtattgcatcatggagctcaactccgacgacgagcccaagcgcatcgtccggctgaacagccgcatcttcaccgaggccgagaacccgaaggacggctccagcctggccgcgccccggcgcgaggcccggggcctccgccggcgcatccggcgccacaagcaccggctggagcgcatccgggccctgctcgtgcgcgagaacatcgtgacgcaggccgagctggacaacatgttctccggcacgctgagcgacatctacgagctccggaccgccgcgctggacgcgcccctgaacaacatcgagttcgcccgcgtcctcatcaacctggctcaacggcgcggcttcaagtccaaccgcaagtcggagaagtccagctccgacaaggagaccgggaagctgctcagcgccatcaagaagaacaaggagtccattgaggccggcgggtatcggaccgtgggcgagatgctgttcaaggatgagcggtacgccaagcacaagcgcaacaaaggggaggcctacctgaacaccgtgagccgcgacatgatcgaggccgagatccacgcggtcttcgcctcccagcggaacttcggcatgcccttcgccaatgagaagatcgagaacgagtacaccgacatcgccctcagccaacgcccgttcgacctgggccccggggagggccccgagaactgcaagagtccctatgccgggaagcagatcaagaacatgatcggccagtgcaccttcttcccggaggagaagcgagcggtgaaggccagctactccttccagctgttcagcctcctgcaaggcataaacaacatcaccctggtgagcagtgacgggaacacgttccctctcagccaggagcaacgaaagaccctgaaggactactgcttcaagaccgccaacgtcacctacgcctccatccggaaggtactgcagatcccccaggagtacactttcaagaacatcacctacaccgacgacggcatcgagaagtccgagaaaaagaccaagttccagcacctcaagccctaccacgagatgaagaaggtgctggggagcgccatccagacgctgaccccggaggagctcgacgagatcggcgagatcttcaccttctacaaggacgagaccatcatcatcaagcagcttgaggagacggaaatcgacaagagcctgtacgacctcctgctgcagttgcccaccttcgagaaagcgggccacatctccaccaaggcctgcaagatgatcatccccttcctggaggagggcaagacctacgacaaagcctgcgagtgcgccggcctgaacttcaaggcccacacgaacatgcagaagcagatgctcctgcccgccaagagcgacgagctgaacgacgtcgtgaacccggtggtccgccgggccatctcccagaccatcaaggtggtgaacgccatcatccgcgagatggggacgagccccacctacatcaacatcgaactcgcccgggagctgtccaagtcgaagaaggagcgcgacgagatcaacaagaagtacaagctgaaccaggcggagaacgagcggctcaagaacgaaataatcgacaatttcaagatcaagcccaacggccaggacatcatcaagttaaagctgtggcacgagcaggacgacgggatctgcccctatacgggcgtccgcatcaagtacgagaacctcttcgacgacgggtacgccgagatcgaccacattatcccgtactcccttagcttcgacgactccttcaacaacaagatcctgaccaccgccacccagaaccggcaaaagggcaacaggatccccctggagtacctcccagagagcgagaaggacggcttccgggtgtgggtgaactccaacatccgcaaccaccggaaacgccagaacctgctgaaggagcacttcacggaggccgacaagaaggagttcaagagccggaacctcaacgacacccgctacctgaacaagctgctcctgaactacatcaacgacaacctcctgttcaccgacttctacaacgggaagaagaagcacgtcacctcggtgaacggcgccgtgacggcgtacatccgcaaacggtgggggatcaataagaaccgcgaggacggcgacctgcaccacgccgtcgacgccgccgtgatcgcctgcgtcacccagggcatcatcaaccggatcaccgcgtacagcgcccgcaacgaggccccctacgacctgaacaccgagactggcgagatcaaggagcggttcccgctcccctaccccaacttcaagaaggagctggacgcccgcacgaccatcgaggacgagaagcggctgaagcgggtgctcatgagcttctcaaactacagctacgacgacgtggagaaggccaagccctgcttcgtctctcggaccccgcaccgcaaggtgaccggcgcggcccacgaggagaccatccggagcgggaaagtggagggctttaccgtatccaagaccgagctgaccaagttgaagctcaccaacggggagatcgagggctactatgagcccgagagcgacaccctgctatacaacgccctcctgcagcgactgaacgagttcggcggggacgccaaggcggcattcgccgacgagttccacaagcccaaggccgacggcaccccggggcccgtggtgaagaaggtcaagaccatcaagcggtccagctccaacgtgaaggcccgcaacaagaacggcctcggggtggcggacaacggcagcatgatccggatcgatgtcttctacgtggagaacgagggctactacttcgtgcccatctacgtcgccgacacggtgaaggagatgcccaacgaggcctgcccgttcgggaaggacaagaagaagatcatgaccgacgacgacttcctgttctccctgtaccctaacgatctcatcaagatcaccgccaagaaggacatgaaattcagcctggccaacaaggagtccggcctgcccaagaacaagtacgcgaacgaggtgctcgtctactacagcgccgccgacatctccaatgccagcatctccgtgatcatgcacgacaacgcctacaagttccgcgggtgcggcatcaagtctctggttaagctggagaaatacaccgtcgaccccctcgggaacgtgagcaaggtgaaccgggagaagcgcatgtacttcaagtga

SEQ ID NO: 7339 - RNA, 3240 nt, synthetic construct
  misc_feature 1..3240: note = Cas9 variant
  source 1..3240: mol_type = other RNA
atgcgacttggactcgacatcggaacatcatcaataggatggtggctatacgaaactgatggcgcagggtccgacgcccgcatcacaggagtcgtagacggcggagtacgtatcttctccgacggccgagacccaaagtcaggggcatctctcgcagtagacagacgagcagcaagagcgatgcgacggagacgtgatcgatacctaagacgcagggccacgctaatgaaagtcctcgcagaaactggcctcatgcccgcagatcccgccgaagcaaaggccctagaagccctcgacccgttcgccctaagagcagcgggactagacgaacccctgccactcccccacctaggcagagcattattccacctgaaccaaagacgaggcttcaaatcgaacagaaaaacagaccgaggcgacaacgagagtggcaagatcaaagacgcaacagcacgattagacatggaaatgatggccaacggtgcccgcacatacggcgagttcctccacaaacgccggcaaaaggcaacagaccccagacacgtgccatcagtacgaaccagactatcaattgcaaaccgcggagggccagacggcaaagaagaggccggctacgacttctatccggaccgccgccacctggaagaagaatttcacaaactgtgggcagcacaaggtgctcaccaccccgaactaaccgaaacattacgagatctactcttcgagaaaatattcttccaacgccccctaaaagagcccgaagtcggactctgcctcttctccgggcatcatggcgtcccaccgaaagacccacgacttcctaaagcgcaccccctcacccagcgccgcgtactatacgaaacagttaaccagctccgggtcacggcggacggccgagaggcaagacccctaacaagagaagaacgcgaccaagtaatccacgcactagacaacaagaaacccaccaaaagtctatcaagcatggtcctaaaactgcctgcacttgcaaaagtactaaaactccgcgacggcgaaaggttcaccctagaaaccggagtaagagacgccatagcttgcgaccctctgcgggcctcaccagcccatcccgatcgcttcggaccacgctggagcatcctggacgcagacgcacagtgggaagtaatcagccggatccgtcgagtccaatcagacgcagagcacgccgcgctcgtagattggctgaccgaagcccacgggctcgaccgagcacacgcggaagcaaccgcccacgcccccttacccgacggctacggtcgccttggcctcaccgcgacaacccgcatcctctatcaactaacagcagacgtcgtcacctacgcagatgcagtaaaagcatgcggctggcatcattccgacggaagaactggcgagtgcttcgacagactcccatactacggagaggtactagaacgccacgtcatccccggctcctaccatcccgatgatgacgacataacaaggttcggacgaatcacgaacccaacagtccacattggactaaatcaactacggcggctagtgaaccgcatcatagaaacgcacggaaaaccgcaccaaatcgttgtagaactcgcaagagatctaaagaaatcggaagaacaaaaacgagcagacataaaaaggatccgcgataccacagaagccgcgaagaagagatcagaaaagctagaagaactcgagatagaagataacggccgaaaccgcatgctcctacgactatgggaagacctgaaccctgacgacgccatgcgacggttctgcccctacacaggcacaagaataagtgccgccatgatattcgacggctcatgcgatgtcgatcacatactaccctattcacgcacattggacgactcattccctaacaggaccctatgcctgcgagaggcaaatcgccagaaacggaaccagaccccctggcaagcctggggcgacacgccccactggcacgcaatagccgcaaacctcaaaaatctgccggaaaacaaacgctggagatttgcaccggacgcaatgaccaggttcgaaggagaaaacggcttcctcgacagagcccttaaggacacccaatatctcgcgcgcatatcccgcagctatctagacaccctatttacaaaaggaggacacgtctgggtcgtacccgggcgcttcacggaaatgctaagacgccactgggggctcaattcccttctctcagacgccggacgtggcgccgtaaaggcgaaaaaccgcacagaccacagacaccatgcaattgatgccgccgtaatagcagcgaccgacccaggattattaaaccgaatctcaagagcagcaggacagggcgaagccgcgggccagtcagcagaactcatcgctagggacacgcccccaccctgggagggattcagagacgacctgcgagtaaggcttgaccgaataatcgtatcacaccgcgccgaccatggcagaatcgaccacgcagcccgcaaacaaggaagagactctaccgccggacaactgcaccaagaaaccgcatattcaatagtagacgacatccacgtcgcgtcacgaacggacctcctcagtttaaaacctgcacaactcctagacgaaccaggccgctccggccaagtacgagaccctcaattgcgcaaagccctcagagtcgcaactggcggaaagaccggcaaagacttcgaaaacgcccttagatatttcgccagcaaacccggcccataccaagccataagacgcgtccgcataatcaaacctctacaagcacaagccagagtgccagttcctgcacaagacccaatcaaggcttaccagggcggcagtaaccatctattcgaaatctggcgcctccccgatggcgaaattgaggcacaagtcataacatcatttgaagcccacacactggaaggcgaaaaacgccctcaccccgccgcgaaaagacttcttcgcgtgcacaaaggcgacatggtagcactagaacgagatgggcgaagagtagtaggccacgtacagaaaatggacatagcaaacggcctgtttatagtccctcacaacgaagcaaacgccgacacgcgcaataacgacaaatcagacccattcaaatggatccaaataggcgcgcgtccagccatagcctcgggaatacgacgcgtctcagtcgacgaaatcggccgactacgcgacgggggcacccgccccatatga

SEQ ID NO: 7340 - RNA, 3240 nt, synthetic construct
  misc_feature 1..3240: note = Cas9 variant
  source 1..3240: mol_type = other RNA
atggacgaggaggccaaaatccagctgagcaaggagtcctacgaggaggagctcgagagcctgctggagaagtccggcgaggagtttcgcgacgtgttcctccaggccaagaaggtctacgacgcgatcctgctgagcgacatcctctccaccaagaagcagaacagcaaggcgaagctgtccctgggaatgatcgagcggtacgacagccacaagaaagacctcgaggagctgaagcaattcgtgaaggccaacctgcccgagaagaccgccatcttcttcaaggactcctctaagaacggctacgccgggtacatcgatggcaagacgacccaggaggacttctacaagttcctcaaaaaggagctgaacgggatagcgggctccgagcgtttcatggagaaggtggaccaagagaacttcttactcaagcagcggaccaccgccaacggcgtcatcccgcaccaggtgcacctgacggagctgaaggcgataatcgagcgccagaagccctactaccccttcctcgaggaggcccgggacaagatgatccgcctgctgaccttccggatcccctactacgtggggccgctcgcgcagggcgaggagaccagctccttcgcctggctcgagcgcaagacccccgagaaggtcaccccctggaacgccaccgaggtgatcgattacagcgcctccgccatgaagttcatccagcggatgatcaactacgacacctacctgcccaccgagaaggtgctcccgaagcacagcatcctgtaccagaagtacacgatcttcaatgagctgaccaaggtcgcttacaaggacgagcgcgggatcaagcaccagttctccagcaaggagaagcgggagatcttcaaggagctgttccagaagcagcgcaaggtgaccgtgaagaagctgcaacagttcctgtcggccaactacaacatcgaggacgctgagatcctcggagtcgacaaagccttcaacagcagctacgccacctaccacgacttccttgacctggcgaagcccaacacggagcgggtggccgaattactggagcagcccgagatgaacgccatgttcgaggacatcgtgaagatcctgaccatcttcgaggacagagagatgattaggacccagctcaaaaagtaccagtccgtcctgggggacggcttcttcaagaagctggtgaagaagcactacaccggctggggtcgcctcagcgagcggctgatcaacggcatccgcgacaagaagacgaacaagaccatcttagactacctcatcgacgacgacgacttcccctacaaccggaaccgcaacttcatgcagctgatcaacgacgactccctgagcttcaaggaggagctcgccaacgagctggccctcgcggggaaccagtctctcctggaggtggtcgaggctctgcccggcagcccagccatcaagaagggcatctggcagacgctgaagatcgtggaggagctcatcgagatcattgggtacaaccccaagaacatcgtggtcgagatggccagagagaaccagcgcaccaaccgctccaagccccggctgaaggccctggaggaggcgctcaagagcttcgactccccgctgctgaaggagcagcccgtggacaaccaggccctccagaaggaccgcctgtacctgtactacctccagaacggcaaggacatgtacacgggggaggccctggacatcgaccggctgagcgagtacgacatcgaccacatcatcccccgctccttcatcgtggacaacagcatcgacaataaggtcctcgtgtccagcaaggagaaccggctgaagatggacgacgtccccgaccagaaggtggtgatccgcatgcggcgctactgggagaagctgctcagagccaacctgatctccgagcgcaagttcgcgtacctgaccaagctcgagctgaccccggaggacaaggcccggttcatccagcgccagctggtcgagacccggcagataacgaagcacgtggccgccatcctcgaccagtacttcaaccagcccgaggagagcaagaacaagggcatccgcatcatcaccctgaaatccagcctagtatcccagttccggaagaccttcgggatccacaaggtcagggagatcaacaaccaccaccacgcccacgacgcgtacctcaacggcgtggtggccatcgccctgctgaagaagtaccccaagctcgagcccgagttcgtctacggcaactacaccaagttcaacctggccacggagaacaaggccaccgcgaagaaggagttctacagcaacatcctgcggttcttcgagaaagaggagtacagctacgacgagaacggggagatcttctgggacaaggcccgccacatcccgcagatcaagaaggtgatctccagccaccaggtgaacattgtcaagaaggtggaggtgcagaccggcgggttctacaaggagaccgtcaaccccaagggcaagcccgacaagctcatccagcggaaggccggttgggacgtgtccaagtacggcggcttcgggagccccgtcgtcgcctacgccgtggcgttcatctatgagaagggcaaggcccgcaagaaggccaaggccattgaggggataacgatcatgaagcagtccctgttcgagcaggacccgatcggcttcctgagcaacaaggggtactccaacgtgaccaagttcatcaagctcagcaagtacaccctgtacgagctggagaacggccgccggagaatggtcgcgtcccacaaggaggctcagaaggccaacagcttcatcctccccgagaagctggtgaccctcctcttctacgcccagcactatgatgagatcgcccacaaggagtccttcgactacgtgaacgaccacctgagcgagttccgggagatcctggaccaggtcatcgacttctccaaccgctacaccatcgcggccaagaacacggagaagatcgccgagctgttcgagcagaaccaggagagcaccgtgcagtccctcagccagtccttcatcaacctgatgcagctcaacgccatgggcgcccccgcggacttcaagttcttcgacgtgatcatcccgcggaagcgataccccagcctgaccgagatctgggagagcaccatcatataccagtccatcacggggctgcgggagacacgcacccggatggccaccctctgggacggcgagcagtga

SEQ ID NO: 7341 - RNA, 3240 nt, synthetic construct
  misc_feature 1..3240: note = Cas9 variant
  source 1..3240: mol_type = other RNA
atggacgaggaggccaagatccagctgagcaaggagtcctacgaggaggagctagagagcctgctggagaagtccggcgaggagttccgcgacgtgttcttgcaagccaagaaggtctacgacgcgatcctgctgagcgacatcctctccaccaagaagcagaacagcaaggccaagctgtccctgggtatgatcgagcggtatgacagccataagaaggacctcgaggagctgaagcagttcgtgaaagccaacctgcccgagaagaccgctatcttcttcaaggactccagcaagaacggctacgccgggtacatcgacggtaagacgacccaggaggacttctacaagttcctcaagaaggagttaaacgggatcgcgggctccgagcgcttcatggaaaaggtggaccaggagaacttcctgctcaagcaacggaccaccgccaacggcgtaatcccgcaccaggtgcacctgacggagctcaaggccatcatcgagcgtcagaagccctactaccccagcctcgaggaggcccgagacaagatgatccgcctgctgaccttccggatcccctactacgtgggtccgctcgcgcagggcgaggaaacctccagcttcgcctggttagaacgcaagactcccgagaaggtcacgccctggaacgccaccgaggtaatcgactactccgccagcgccatgaagttcatccagcggatgatcaactacgacacctacctgcccaccgagaaggttctcccgaagcactccatcctgtaccagaagtacacaatcttcaacgagctgaccaaggtcgcgtacaaagacgagcgcgggatcaagcaccagttcagctccaaggagaagcgggagatctttaaggagctattccagaagcagcgcaaggtgaccgtgaagaagctgcagcagttcctgagcgccaactacaacatcgaggacgccgagatcctcggcgtcgacaaggcctttaacagctcctacgcaacctaccatgacttcctggacctggcgaagcccaacacggagcgggtggccgaactcctggagcagcccgagatgaacgccatgttcgaggacatcgtgaagatcctgaccatcttcgaagaccgcgagatgatccggacccagctcaagaagtaccagagcgtcctgggggacggcttcttcaagaagctggtgaaaaagcattacaccggctgggggcgcctcagcgagcgactgataaacggcatccgcgacaagaagacgaacaagactatcctggactacctcattgacgatgacgacttcccctacaaccggaaccgcaacttcatgcagcttataaacgatgacagcctgagtttcaaagaggagctcgctaacgagctggccctggcggggaaccaaagcctcctggaggtggtcgaggccctgctgggctccccggccatcaagaaggggatctggcagaccctcaagattgtggaggagctgatcgagattatcgggtacaaccccaagaacattgtagtcgagatggcccgggagaaccagcgcaccaaccgcagcaagccccggctgaaggccctcgaagaggcgctgaagtccttcgacagccccctgctcaaagagcagccggtggacaaccaggccctgcagaaggaccgcctgtacctctactatttgcagaacggcaaggacatgtacacgggggaggccctggacatcgaccggctctccgagtacgacatcgatcacattatcccccgcagcttcatcgtggataactccatcgacaacaaggtcctggtgagctccaaggagaaccggctgaagatggacgacgtccccgaccagaaggtagtgatccgcatgcggcgctactgggagaagctcctgcgggccaacctgatcagcgagcgcaagttcgcctacctcacaaagctggagttaacccccgaggacaaggcccggttcatccagcgccagctcgtcgagacccggcaaattacgaagcacgtggccgccatcctggatcagtacttcaaccagccggaggagtccaagaataagggcatccgcattatcaccctcaagagctccctcgtgagccagttccggaagaccttcgggattaacaaggtccgcgagatcaacaaccatcaccatgcccacgacgcgtacctgaacggggtggtggccatcgccctgctcaagaagtaccccaagctggagcccgagttcgtatacggcaactacaccaagttcaacttggccacggaaaacaaggccaccgcgaagaaggagttctacagcaacatcttacggtttttcgagaaggaggaatactcatacgacgagaatggggagattttctgggacaaggcccgccacatcccccagatcaagaaggtgatcagctcccatcaggtgaacatcgtcaagaaagtggaggtgcagacaggcggtttttacaaggagaccgtcaacccgaagggcaagccggacaagctgatccagcggaaggccgggtgggacgtgagcaagtacggcggcttcgggtcccccgtggttgcctacgccgtggcgttcatctatgagaagggcaaggcgcgcaagaaggccaaggccatcgagggcatcacgatcatgaagcagagcctgttcgaacaagaccccatcggctttctctccaacaagggctacagcaacgtgaccaagttcatcaagctgtccaagtacaccctgtacgagctcgagaacggccgccggcgcatggtcgccagccacaaggaggcccagaaggcgaactctttcatccttcctgagaagctggttaccctcctgtaccatgcccagcactacgacgagatcgcccataaggagagcttcgactacgtgaacgaccacctgtccgagtttcgggagatcctcgaccaggtcatcgacttcagcaaccgctacaccatcgcggccaagaacacggagaaaatcgccgagctgttcgagcagaaccaggagtccaccgtgcagagcttatcccaatcattcatcaacctcatgcagttaaacgccatgggcgcccccgcggacttcaagttcttcgacgtgatcatcccccggaagcgctacccgagcctgaccgagatctgggagtccaccatcatctaccagagcatcacagggctccgggagacccgcacgcggatggccaccctgtgggacggagagcagtga

SEQ ID NO: 7342 - RNA, 3243 nt, synthetic construct
  misc_feature 1..3243: note = Cas9 variant
  source 1..3243: mol_type = other RNA
atgaaaacgtcgttcgcattcgacataggaacaaactctatagggtggtgcgtactagcactggataacgcgaacctaccataccgaatactagatgctggagtcagaatatttagcgatggacgcgaaccaaaatccggcacaagcctcgcggaaggcagacgactagctcgaggaatgagcaggcgtagagacaggtacaaacgcagacggaaggctgtcatccgaacacttatagaatacggcctgatgcccgacgaccccgcagcgcggagagcactcgtggcagagactaatgacaaagcacccgggaagatcgcgagcgacgtgtacgcactaagggcccgagcactcgacgataaactgcccctacaccacataggtcgcgccctctttcacatcaaccaaaggagaggcttcaaaagcaaccgcaagacagacaagcgagacaacgaccagggcaaaatagcttcaggaatatcccggctccgcgacaaactagccagcgaaggcatgagaacgctgggggaatacctcaaccacaggcaccaagcgggaaactgggtccgagtaagaccaagccgagtacccgggaaagacgataaagaagaagacggctacggattctatcccgagcgagcactcctacaggacgaatttaacgcgatctggacagcacaggccgcccactacccagacgtcctcaccgaagaacgccgtacccacctagaaaccatcatcttcttccagcgaccactcaaacccgtacaagtcggtaagtgctcgttcaaccccggggaagaacggctaccccgcgcccatccactattccaagagttccgcttatacaaagaagtaaacgaactggagctagtcgacagaaatcaagaccaccacaaactgagtctcgaccagcgagacgcactcatagcacagctaaagacgcagagagaagccgcatactcagcgctcagaaaaacagcgagagcgccattaggcacgcggttcaacaaggagacagaaagccgaacaaagatgaaaggagatgaagtcgcagcggaactgagcgccaaaacaaggttcggacaagcatggataagtatgccactcgaggaacgctggatcatagtagacaccctaagaagggtcgaggaccccctggaactaactgcatggctagaacaacattacgggctagacggagaacatatagacgcgatcctagcagcaagactaccagaagggtacggacgcctcggagaaacggcactaacagagatactggtcgaacttaaggccgccgtaatatccgaagccgaagcagcgagacgggccgggtacgaccatgccctgctccaaaggggcgccggtctggaggccctcccaaagtaccaagaagtaattgcaaggcgcattcccccgggaaccggcaatcccgacgacccctacgacgtcgaaaaaggcagaataacaaaccccacggtccacatagggctaaaccaacttcagaaagtcttaaacgccctaattcgccgatacggtaagcccgaacagatcgccatagaactcgcacgggaactcaaattaaacgacgagcaaaaacgcgagaaaaacatcgaaattgcacgcaacacacgcgccgcagaacaaagatcagccaagttagtagagctgggcgtacccgacacaggctacaaccgcgtactccttaaactatgggaggaactaaacctgcgcgcacccgaaaacagagtatgcatatactgcggagaacctatcaacatagaaacccttttctcaagcgcagtagacatcgaccacatactgccatggtcaaagacactcgatgactcacaagcaaaccgtctagtatgccacgtggcatgcaacagacaaaaagctaactacgcaccagccgaagtcccacaatggcaaggacgatacgacgatatcctggcacgggcaaatacactccccctcaataagcgatggagattcgggagagacgcgatgaaaaagttcgcagacgaagagaccttcctcgcgagacaactaacagacacacaatacctatccagactagcacacgcatacatggcggccctatacccagacgaagaaccggacgcgcaaggggtcctcgcacggaaaaaccacgtacgcgtaataaccgggcggatgacggaaatgctaagacgccaatggggactgaacagcctcctcgcggaccacaaccagaaaaacagaaacgaccaccgacaccacgccatcgacgccgcggtagtgggcgtgacaacacgcgcccttcttcaacgaatcgcaaccgtcgctgggggccgagaggcccaagcgctggaagaaacaattgggaaaatagaaccaccatggcccggtttccgcgacgaactccaagcagtcataaaacgaatagtagttagccacaaaccggaccacggcacactaccaaaacccggccaaggcggccaaacggcaggacaactacataacgacacggcatacggactcacaggcgaaacagactcaagaggcactccaatcgtggtcagacgcaaacccttcacaagcctaacagagaaagacctgccctcaatacgcgaccgccaactagcgcaggccctaggatcagccatagcaggtcgaagtggaaaggaactgcaagcagctctggagcagttccgcgacagagacgactacaagagcatccgccacgtaagagtcgtggagccactgaacgtcatccccatacgagacggcacggggcgcgcctacaaagcatataaaggggacgcaaactaccgatacgacgtctgggaactcccgaacggcaaatggatgcatgaggtcgtgagcatgttcgatgcccacgacagatcatggacctccgctgtccacatccaccaccccgccgcgcgcagagtactctcgctaaaacaaaacgacatggtcgcctacgaccacccacaagacggaccgacaataggaagggtagtgaaattcagccaaagcggacagatgacattcgccccacataaagaagcaggcgcactaaaagcacgtgacgcagaccccgaagaccgcttcaggtacttctacaaatccggaagcgccatgaaagatatcggcctccgccaagtacgcgtcgacgagatcggacgcgttttcgaccccgggccacgcgacaaagaagcaaggaacgcacgcaaaaagaaaagcacagattga

SEQ ID NO: 7343 - RNA, 3243 nt, synthetic construct
  misc_feature 1..3243: note = Cas9 variant
  source 1..3243: mol_type = other RNA
atggcaaagagcttcgcattcgacatgggcacgaactcaataggatgggcagtcctgggactagacagcgcaggcgaccccgactcgattgagggagcaggagtaagaatattcagcgacggacgagaacccaaaagcggagcctcactggcagaagggagaagaatagcccgtgggatgagccgcagaagagaacgatacaaagcgcggcgcaaagcgctcatacgcaccctcggcgactacggactcatgccattagaaagggcagccaggagggcgctagtagctgaaacaaacgacagatcattcggattggtcgcacaggacgtctatgccctaagagcccgcgccttagtagaaaagctcccaccataccacctgggcagagccctcttccacctaaaccaacgaagaggattcaaatccaaccgcaaaacagacggacgcgacaacgaactgggcatgatcgcaacaggtatcgcagccctggacgctcaactaaacggaagaaccctagggcaatacttacacgaaatgagaggagcggacccgagacaaaggggacaagtgcgagtacgaccacacctcgaaatcaacgacaaaggaagggaaatcgccgcatacggattctaccctcagagagcaatgttagagcgagagttcaacgccatctgggccgcacaagcaccccaccacccagaactgctctcggaagaaagacgagcccacttattccaggtaatattctatcaaagaccgctaaagcaacccgaccccggccgatgctcattcaacccagcagaaccgcgactcgctaaagcccacccacttttccagagattccgactggtcaaggaaatcaacgaactacgcatcgtcaccggcagcaatagccaaggcgtgcccctcacactagaacaacgcgatatcctcctcacgctgctacgagataagaaagcatccagtttcaaaacgctactggcaaaaatcataaaaggccagcctgaagctcgcttcaacaaagcctcggactcaagagacaagatgaagggggacgaactggcggcaacaatgtccgacaaaacccggttcggccaagcatggttcgccatgcccgaagctgaacaatggcgcatcatagcgaaactacgtgacattgacgacccactcgaactaaacgcctggctcgaatcagaatacggcctcgcgcccgaaagaagagacgctgttgccaacgcactacttccacagggatacggccgacttggagaaacggcactacgcacgatgctagactacttagaggcagctgtgataagcgaagcagaagccgccgcccaggccggatacgaccacgcactcgcgcgcagaggcgcgggcctcgaccaactacccaaataccaagaagtgttgggcaggcgtatcccaccaggctcaggtgaaccaaacgacccatacgatatccgaatgggacgaatatccaatccaaccgtccatatcgccctaaatcaattgcgaagagtcgtaaatgcgctcatacgtaaatacgggaaacccgccgaaatcgcaatcgagctagcccgagacctaaaactctccgaagaacaaaaacgggaggtaaacgcaaccatagccaaaaacacccgagacgcagaaagacgagctgtaagactcgcagacgaaggcatagacaacacaggacacaaccgagcgctactacgattctgggaagagttagcagccgacccgctagatcgagtgtgcgtatattgcggcggaggaataggcgcagcctcactattcaacggaagcgtcgacatcgaccacatcctgccatggagtaggacgctcgacgacagcagagccaacagaatactcgtacacaactcatgtaatagacttaaaaggaatttcgcgcccttcgaagtacccgaatggagagaaatataccaagacatacttgtacgagcggccaaactcccggcaaataaatcatggcggttcgcgcccgacgccatggaccgattcgagggcgaaaaagacttcctagcccgacaactcaccgacacccaatatctcgcacgtatggcccacgaatacctagctgccctttaccccgacgaagaaccagacgaatggggagtcttcgctcgaggaaaccatgtaagagtagtcccaggacgactaacagaaatgttacgacgagcctggggcctaaacgccatcctatccgatgacaacaggaaaaacagaaacgaccacagacaccacgctatagacgcggtcgtcgtaggtgtcacaaccagagacatgctcaataaaatatctcaagcagcgggcaggggcgcagacatgggagccgccgacgcactccgaagattcgaccctccatggcccagcttccaccaagccgtacgagccgccgtagaacgcatcctagtctcccaccgcgcagaccacggaacgctgcccggtacggacggacaaggctcgacagcaggacagctccataacgacaccgcctacggcctgactggggagacacgtaaaggactagctgtcgtcgtacgaaggaaaccatacctctccctagagccaagagatatagaaacaatcagagacccgcaactgcgagaccacctagctacagaaacgtacggactagcaggcgccgagttcaccgcagccctaaaaaggctccagcaaacagacaagttctacgcaggaatcagacgcgtgcgagtaaccgaagcactgagcgtcatcccaatcagggacgccacaggacacgcatacaaagcctacaagggggacgctaatttcagatacgacgtatgggaactccccaacggtaaatgggtacccgaagtaatcagcatgttcgatgcgcacgaccgtggctgggtctcacaggtccacgcagcaaacccagccgcacgaagagtattaagcctaaggcaaaacgacatggtagcataccaacaccctgaacaaggacttgtgtacggacgcgtagtcaaattcgggcaatcgggccagatgacattcgccgcccaccacgagggaggaagcctcaaatcacgagatgcagaccgcgatgacccattcaagtacttctacaaaagcgcgggcacgatgaaagacatcggcctacgccaaataagagtagacgaaatcggcagagtgcaagaccctggcccacaagatcgcgatagcaaacgcgtacgaaaaagcgaccgttga

SEQ ID NO: 7344 - RNA, 3246 nt, synthetic construct
  misc_feature 1..3246: note = Cas9 variant
  source 1..3246: mol_type = other RNA
atggccgccttcaaaccaaacccaataaactacatactcggtctcgacatcggaatcgccagcgtaggatgggccatggtagaaatcgacgaagacgaaaaccctatctgcctgatagatctcggagttcgcgtcttcgaaagagccgaggtacccaaaacgggagacagcctggccatggctagacgtctggcaaggagcgtacggcgactcaccagacgacgcgcccaccgcctcctgcgagcgcgacgcctactgaaaagagaaggggttctccaagcggccgatttcgatgaaaacggcctaatcaaaagcctgcccaacacaccatggcaactcagggcagccgcactcgatcgcaaactaacgcccctagaatggtccgcagtactcctgcacctgataaaacacaggggctacctaagccaacgcaaaaacgaaggagaaaccgctgataaagaactaggagccctcctgaaaggcgtagctgataacgcgcacgccctgcaaaccggtgacttccgcacgcccgcaaaactggcattaaacaaattcgaaaaagaaagcggccatatacgcaaccaacgcggcgactactcacacactttcagccgaaaagacttgcaagcggaactcaacctactcttcgaaaaacagaaagagttcggcaacccccacatctcagacggactaaaagaaggcatcgaaacactactgatgacgcaacgaccggctctcagcggcgacgcagtccagaaaatgctaggacactgcactttcgaacccacagaaccaaaagcagccaaaaacacatacacagcagaaaggttcgtgtggctgactaagctcaacaacctcagaatcctagaacaaggatccgaacaacccctaaccgacacccaacgagcaaaactcatggacgaaccctacagaaaaagcaaactcacctacgcccaagcaagaaagctcctcggactcgaagacacagcattcttcaaagggctaaggtacggaaaggacaacgcggaagcaagcacactcatggaaatgaaagcataccacgccatatcgcgcgcgctagaaaaggaaggcctcaaagataagaaaagccccctcaacctatcgccagagctccaggacgaaataggaaccgccttctccctattcaaaacagacgaagacatcacaggacgcctcaaggaccgcgtccaacccgaaatacttgaagccctcctgaaacatattagcttcgacaaattcgtacaaatatcactaaaggcactaagacgaatcgtgccactgatggaacagggcaagcgctacaacgaagcatgcgcagaaatctacggagaccactacggaaagaaaaacaccgaagagaaaatatacctaccacccatacccgcggacgaaatacgaaacccagtagtactgcgcgccctaagccaggcacgcaaagtcataaacggagtggtgagacgctacggatccccagcacggatccacattgaaacggcccgggaagtaggaaagagcttcaaggaccgaaaagaaatagagaaacgccaggaagaaaaccgcaaagatagagaaaaagccgccgcaaaattccaagaatatttcccaaacttcgtcggcgaaccaaagagcaaagacatacttaaactacgactatatgaacaacagcacggaaagtgcctctacagtggaaaagaaataaacctgggacgactgaacgaaaaaggctacgtagaaatcgaccatgccctcccgttcagcagaacttgggacgactcattcaacaacaaggtgctagtactgggaagcgaaaaccagaacaagggcaaccaaacgccctacgagtatttcaacggcaaagacaactcccgtgagtggcaagagttcaaagcccgcgtagaaaccagcagattcccgagatcaaagaaacagcgaatactactgcaaaaattcgacgaagacggattcaaagagaggaacctaaacgacacacgatacgtaaaccgtttcctatgccaatttgtcgcagaccgcatgagacttaccggcaaaggcaagaaacgagtattcgcgtccaacggacaaatcacaaacctcctccgtgggttctggggtctgcgaaaggtacgagcggaaaacgacagacaccacgcccttgacgcagtagtagtcgcgtgctccaccgtagccatgcaacagaaaatcacaagattcgtccgctataaagagatgaacgccttcgacggcaaaacaattgataaggagaccggcgaggtactccatcagaaaacccacttcccccaaccatgggagttcttcgcccaagaagtcatgatcagggtattcggcaaaccagatggcaaacccgagttcgaagaagcggacacacccgaaaagctccgcacccttcttgcggaaaaactatcatcccgacccgaggcggtccacgagtacgttacaccactattcgtaagcagagccccaaaccgaaagatgtccggccaaggacacatggaaacggtcaaaagcgccaagcgccttgacgaaggggtctcagtcctcagagtaccgttaacccagctcaagctcaaggacctcgaaaagatggtcaaccgagagcgcgaacctaaactatacgaagctctaaaagcacgcctagaagcccataaagatgacccagcaaaagcattcgcagaacctttctacaagtacgacaaggccggaaaccgaacgcaacaagtaaaagctgttagagtcgaacaagtacagaaaacaggcgtgtgggtacgcaaccacaacggcatcgcagacaacgcaacaatggtacgcgtcgacgtattcgaaaagggagacaaatactacctcgtgccaatttactcctggcaagtcgccaaaggcatcttacccgatcgcgcggttgtagcatacgcagacgaagaagattggaccgtcatagacgaatcgttcaggttcaaatttgtcctctatagcaacgacctcataaaagtacaactcaagaaagacagcttcctaggatacttcagcggactggaccgagccacaggagcaataagccttcgcgagcacgacctagaaaaatcgaagggcaaagacgggatgcacaggatcggcgtaaaaacagcactctccttccaaaaataccaaatagacgaaatggggaaggagatccgaccatgccgcctgaagaaaagaccgcccgtccgatga

SEQ ID NO: 7345 - RNA, 3246 nt, synthetic construct
  misc_feature 1..3246: note = Cas9 variant
  source 1..3246: mol_type = other RNA
atggccgcatttaaaccaaacccaatcaactacatactcggcctggacatagggatagcgagcgtgggctgggcaatggtcgaaatagacgaagacgaaaaccccatctgcttaatcgacctaggagtccgcgttttcgaaagagccgaagtgcccaaaacaggagactctctcgccgccgcccgccgactggcccggagcgtcagacggctcacaagaagacgagcccaccgcttactacgcgcaagaaggctactcaaaagagaaggagtcctgcaagcagccgacttcgacgaaaacggacttatcaaatcactgcccaacacgccctggcagctacggagcgcggccctagaccggaaattaacgccactagaatggtcagcggtactcctccacctcataaagcaccgaggatacctctcacagcggaagaacgaaggcgaaaccgccgacaaagaactaggagccctcctaaagggcgtggcagacaacgcgcacgcactacaaacaggggacttccggacaccggcagaactcgctctcaacaaattcgagaaggaatcggggcacatacgtaacaggcgaggcgactactcacacactttctcaagaaaagacctccaagctgaactagacctactcttcgaaaagcaaaaggagttcggcaacccacacatatcggacgaccttaaagagggtatcgaaacactcctgatgacccaaagaccggccctaagcggagacgccgtgcagaagatgctaggccattgtacattcgagccgacggagcccaaggccgccaaaaacacctacaccgcggaacggttcgtatggctcacaaaactaaacaatctccgaatcctcgagcaagggtccgaaagacccctgaccgacaccgaacgagccacgctcatggacgagccttatcgaaaaagcaaactaacctacgcacaagcccgcaagctattagaactagacgacacagccttcttcaaaggactacgatacggaaaggacaacgcagaagccagtacgctaatggaaatgaaagcataccacgccataagtagggcactcgaaaaggaagggctcaaggacaagaaaagcccattaaacctcagcccagaactacaagacgaaataggcacagccttcagcctgttcaaaacagacgaggatataacaggcagactcaaggaccgagtccaaccagaaatactcgaggtcctacttaaacacatctcgttcgacaagttcgtacaaatatccctaaaggccctacgtaggatcgtcccgctcatggaacagggaaaaagatacgatgaagcatgcgcggaaatctacggcgaccacgacgggaagaaaaacacggaagagaaaatctacctcccacccatccctgctgacgaaatccgcaacccagtggtgctacgcgcgctatcacaggcgcgcaaagtcataaacgcagtcgtccgccgttacggaagtcccgcccgaatacacatcgaaacagccagagaggtcggaaagagcttcaaagataggaaagagatcgagaaaaggcaggaagaaaaccgaaaagacagagaaaaagcagccgccaaattcagagaatacttcccaaacttcgtgggggaacccaagagcaaggatatcctaaaactacgactgtacgagcaacagcacggaaaatgtctgtactccggaaaagaaataaacctcggccgactaaacgaaaaaggatacgtcgaaatagaccacgcgctgccattcagccgtacctgggacgacagcttcaacaataaggtcctagtactaggaagtgagaaccaaaataagggcaaccaaaccccctacgagtacttcaacggcaaagacaacagccgggaatggcaagagttcaaagcacgcgtagaaacaagccgattccctagaagcaagaaacaacgcatactcctacaaaaattcgatgaagagggattcaaagaacgaaacctaaacgacacgaggtacgtaaaccgcttcctgtgccagttcgtagcggaccacatgctgctaaccggaaaaggcaaacgccgcgtcttcgcaagtaacggacaaatcaccaacctactccggggattctggggcctccggaaagtccgagccgaaaacaaccggcaccacgccctagacgcggtcgtggtagcctgcagcaccgttgctatgcaacaaaagatcacaagattcgtaaggtacaaagaaatgaacgccttcgacggcaaaaccatcgacaaagagaccggcgaggtactccaccagaaaacgcacttcccccaaccatgggagttcttcgcgcaagaagtgatgataagagtatttggcaaacccgacggtaagcccgagttcgaagaagcggacacgcccgaaaaacttcgaaccctactagcagaaaaacttagctcccgacctgaagcagtccacgaatacgtaaccccactcttcgtatcaagagcacccaaccgaaaaatgtcgggacaaggccacatggaaaccgtcaaaagcgcaaaaagactcgacgaaggggtatccgtccttcgcgtcccactcacacaactcaaactaaaagacctagagaagatggtgaacagagaaagagaaccgaaactctacgaggcgctaaaggcaaggctcgaagcacacaaggacgaccccgccaaagccttcgcggagccgttctacaaatacgacaaagcgggtaaccgaacccaacaggtaaaagccgtccgcgtagagcaggtccagaaaaccggggtctgggtgcggaaccataatggtatagcggacaacgccactatggtccgcgtcgacgtcttcgaaaaagctggaaagtactacctagtgccaatatacagctggcaagtagcaaagggaatactgccggaccgggcagtcgtcgcctacgcggacgaagaaggatggaccgtcatagacgaatcattccgattcaaatttgtcctttacagtaacgacctaataaaagtccaactaaagaaagatagcttcctaggttacttcagcgggcttgaccgagccacaggcgccatcagcttgcgagaacacgacctagagaaaagcaaaggaaaagacggcatgcatagaataggagtgaaaacagcactatccttccaaaagtaccaaatagacgaaatgggcaaagaaataaggctatgtagactgaaaaagcggcccccagtgcgctga

SEQ ID NO: 7346 - RNA, 3246 nt, synthetic construct
  misc_feature 1..3246: note = Cas9 variant
  source 1..3246: mol_type = other RNA
atgaccgccttcaaacccaaccccatcaactacattctcggactcgacatcggcatcgcctccgttggctgggccatggtagaaatcgacgaggaggaaaacccgatcagactcatcgacctcggcgtcagggtcttcgaaagagctgaagtgccgaagaccggcgacagcctagcggctgcccgtcgactcgcccgaagcgttcgaagactaacccgcagacgagcccacagactactgagagcaaggcgtctactgaaaagggaaggcgtcctgcaagcagcggacttcgacgaaaatggcctcataaaatccctaccaaacaccccctggcaacttcgagctgcagctctggacagaaaactcacacccctggaatggtccgccgtactactgcatctgataaaacaccgcgggtacctctcgcagcggaaaaacgagggggaaaccgcagacaaagaactgggcgcactactaaagggagtagcggataacgcccacgccctccagaccggagacttccgaaccccagccgagctcgccgttaacaaattcgaaaaggaaagcggccacatccgcaaccagagaggggactacagccacaccttctcaaggaaagacttacaagctgagcttgtcctcctattcgaaaaacaaaaagagttcggtaacccccacatcagtgacggactcaaagaaggaattgagacactcctcatggcccaacgacctgcactctccggagacgccgtccagaaaatgctaggatactgcacattcgaacccaccgaacccaaagcggcgaagaacacctacacagcggagcgattcatctggctcacgaaactgaacaacctaaggatactagaacaaggaagcgaacgcccgctaacggacaccgagcgcgccaccctcatagacatgccctacaaaaataaactcacctatgcgaaagcccgagaactactcggactcgacgacaccgcattcttcaagggcctcaggtacggaaaggataacgcagaaagcgcaaccttaatggagatgaaggcttaccacgccatacgcagagccctagaaaaagaaggcctaaaggacaagaaaagcccgttatcactctcgccagaactccaagacgaaatcggcaccgcgtttagcctattcaagacagacgaagacatcacaggccgcctcaaaggatgcctgcaaccagaaatcctcgacgcccttctgaaacacatcaatttcgacaaattcgtccaaatcagcttgaaggcactgcgaagaatcgtaccactcatggaacaaggaaaacgatacgacgaagcctgcgccgagacctatggagaccactacggcgagaaaaactcagaagaaatgctgtacctaccaccgatcccagcggacgaaatccgcaacccagtggtcctgcgggcgctgtcacaagcacgaaaagtcattaacggagtagtccgcaggtatggctcacccgcccgaatacacatcgaaacagctcgagaagtaggaaagagcttcaaagaccgcaaagaaatagagaaacgccaagaagagaatcgaaaggacagggaaaaggccgctgccaaattccgcgaatacttcccgaacttcgtcggagaacccaaaagcaaagacatcctgaagctgcgcctatatgaacaacaacacgggaaatgtctctacagcggaaaagcgatcgacatcagacgactcaacggcaaaggatacgtcgagattgatcacgcactaccattcagccgaacctgggacgactccttcaacaacaaagtcctcgtattaggatcagaaaaccaaaacaagggtaacagaacaccatacgaatacctaaacggcaaagacaacagccgagagtggcttgagttcaaagcaagagtggaaacaagccgcttcccccatagtaagaaacaaagagtgctcctacaaaaattcgacgagaaaggcttcaaagagcgcaacctaaacgatacgagatacgtcaaccggttcttgtgtcaattcgtagccgaccacatgcaactgaccgggaaaggcaaacggagagtattcgcttccaacggtcaaataactaacctcctgagaggcttctggggattacacaaagtaagggcagaaaacgaccgacaccacgcgctagacgcggtcgtggtagcatgctccaccgtcgcaatgcaacagaaaataacatgtttcgtcaggtacaaagaaatgaatgcattcgacggcaagacagtagacaaagaaaccggagaagttcttcaccaaaagacccacttcccacaaccctgggagttctttgctcaagaagtaatgatccgtgtttttggtaaaccagacggcaaacccgagttcgaagaggcagacacccccgagaaactaagggcactgctggctgaaaaactttcctcccgccccgaggcagtccacgaatacgtcacaccactattcgtctcacgagccccgaatagaaaaatgtccggcgcacacaaagatacactccgctcggcaaagcgcttcgtaaaacacaacgagaaaataagcgtaaagcgcgtctggctaactgagattaagctggctgacctagagaacatggtcaactacaagaacggccgggagatcgaactctacgaggcactaaaagcgagattaggcgcctacggaggcaacgccaaacaggctttcgacccaaaagacaaccccttctacaagaaaggaggacaactcgtaaaagccgtaagagtcgagaaaacccaagaatccggcgtcctcttgaacaagaaaaacgcgtacaccatcgccgacaacggagacatggtacgcgtagacgtattctgcaaagtagacaagaaaggcaaaaaccagtacttcattgtacccatctatgcctggcaagtcgcggaaaacatcctccccgacatagattgcaaaggataccgcatagacgacagctacacattctgcttctccctccacaagtatgaccttatagcgttccagaaagacgaaaagagcaaagtcgagttcgcttactacatcaactgcgattccagcaacggaagattctacctagcatggcacgacaaagggagcaaagagcaacaatttagaatcagtacccaaaacctagtcctcatgcaaaaatatcagatagacgagctcggcaaggaaatacgaccgtgccgcctaaagaagcgaccaccagtcagatga

SEQ ID NO: 7347 - RNA, 3246 nt, synthetic construct
  misc_feature 1..3246: note = Cas9 variant
  source 1..3246: mol_type = other RNA
atggcagcgttcaagcccaaccccataaactatatattgggactggacatcgggatagccagcgttggatgggcaatggtggaaatcgacgaagatgagaaccccatctgcctcatcgatctaggtgtcagagtcttcgagcgcgccgaagtccccaaaacaggggacagcctagctgcagcacgaagactcgcgcgctccgtccgccggctaacgcgccgacgggcacaccgactactacgagcgcgacgactactcaaaagagaaggagtactacaagcagccgacttcgacgagaacggactaataaaatctctgcccaatacaccctggcaactacgctccgcagccctggatcgaaaacttacaccgctcgagtggtccgccgtcctgctgcatctcatcaaacatcgagggtatctgagccaacgaaagaacgagggcgaaaccgccgacaaagaactaggcgcactactcaaaggcgtcgcaaacaacgcgcatgccctgcaaactggcgactttagaacaccagcagaactggctctgaataaattcgagaaagaaagcggacacatacggaaccagcgaggtgactacagccacacattcagccgaaaagacctccaagcagagctaattctcctattcgaaaaacaaaaagagttcgggaacccccacgtcagtggaggcttgaaagagggcatagaaacactactgatgacacagcggcccgcgctcagcggagacgcggtacaaaagatgctaggacattgcaccttcgagcccgcagaaccgaaagctgccaaaaacacctacaccgcagaacgcttcatatggctgacaaaactgaacaacctccgtatcctagaacaaggctcggagagaccactcacggacactgaacgcgccacgctaatggacgaaccctaccgaaaaagcaaactcacatacgcccaagccagaaaattactcggcctcgaagacaccgcattcttcaaaggcctccggtacggcaaagacaacgccgaagcctcaacactcatggaaatgaaggcctatcacgcaatcagcagagccctagaaaaagaaggacttaaggacaaaaagagcccactcaacctcagcccagaactgcaagacgagatcggcacagcattttcactattcaagacggatgaggatataaccggacgcctaaaagacagaatccaaccggagatcctagaagcactcttaaaacacatatccttcgataaattcgtccaaatcagcctgaaggcactccgccgtatcgtccctctaatggaacaaggaaagcgctacgacgaagcctgcgcagaaatatacggagaccactacggaaagaaaaacacagaggagaaaatatacctaccgcccatccccgccgacgaaatacgcaaccccgtcgtactgagggcgctgagccaagcaagaaaagtcatcaacggagtcgtcaggcgatacggaagccccgcccgcatccacatcgaaacagcacgagaggtcgggaagagttttaaagaccgtaaagagattgaaaaacgccaggaagaaaaccgaaaagacagagaaaaagcagcagctaagttccgggaatacttcccaaacttcgtaggcgaaccaaagtcaaaagacatcctaaagctacgcctgtacgagcaacaacacggaaagtgcctgtacagtggcaaagagatcaacctaggccggctcaacgagaaaggatacgtagagatagaccacgccctaccattcagtcgaacgtgggacgacagcttcaacaacaaggtcctagtactcggctccgagaaccaaaacaaaggcaaccaaacaccgtacgaatacttcaacgggaaagacaacagcagggaatggcaagagtttaaagcccgcgtagaaacctccagattcccgcgctcgaaaaagcaacgaatcctcctccaaaaattcgacgaggacgggttcaaagaacgaaacctaaacgacactagatacgtaaacagattcctctgccaattcgtagccgaccgcatgcgcctgaccggcaaaggcaagaaacgcgtgttcgcatcaaacggtcaaattacgaacctgctcagaggcttctggggcctgagaaaagtacgagcagaaaacgaccggcaccacgcactagacgctgtagtggtagcatgctcaacagtcgcgatgcaacaaaagatcaccagattcgtgcgatacaaagagatgaatgccttcgacggcaaaacaatagacaaagagacgggcgaggtcctacaccagaaaacccacttcccacaaccctgggagttcttcgcacaggaggtaatgatacgggtcttcggcaaacccgacggcaaaccggagttcgaagaagctgatacccccgagaaactccgcaccctactcgccgagaaactatcatccagacccgaagccgtccacgaatacgtaaccccgctctttgtaagcagagcacccaaccgaaaaatgagcggacagggacacatggaaacggtcaaaagcgcaaaaaggctagacgaaggagtaagcgtccttcgagtaccactcacccagctaaaattaaaagacctggagaaaatggtcaacagagaaagagaacccaaactatacgaagcactaaaagcacgactagaagcccacaaagacgacccagcaaaagcattcgcagagccgttctacaaatacgacaaggcggggaacaggacgcaacaagtcaaagccgttagggtcgaacaagtccagaaaaccggagtatgggtcagaaaccacaatggcatcgcagacaacgccacaatggtaagagtagacgtattcgaaaaagccggcaaatactacctagtgccaatctactcgtggcaagtcgccaagggcatcctacccgacagagcagtagtagcatacgcagacgaagaaggatggaccgtcatagacgaatcatttcgcttcaaattcgtcctttactccaacgatctcataaaagtacaactcaaaaaggactcattcctcggctacttcagtggcctcgaccgggctacaggggcaatctccctccgagagcacgatctcgagaaaagcaaagggaaggacggaatgcacagaataggcgtgaaaacagccctatcgttccaaaaataccaaatcgacgaaatgggaaaagaaatcagattatgcaggctcaagaaacgcccacccgtgagatga

SEQ ID NO: 7348 - RNA, 3246 nt, synthetic construct
  misc_feature 1..3246: note = Cas9 variant
  source 1..3246: mol_type = other RNA
atgttgaaacgcgtgcttggaatagacgtcggaatctcgagcataggatgggcactgctagagttccaaggcgacatagacaacaaggaccttccctccggcaaaatcctcgccagcggagtgcgagtgttcacacaagcggaaaacccgaaaaatggggaatcacttgcaaaacccaggcgcgacgcacgcctagctagaaggagaacgcggcgcagagcccagcgcctcacggatatcaaagacctcttcttcaaatacaaactggtaacgggcatctcccgaaacaagataaactcaatctacaagacggaagaaaataagaaagacccatggacactccgcaaagaagccctgtaccgaaaattagacggagaagagttcgcgagagtactaacacacatagccaaacaccgcggtttcaaatcaatgaggaaatcggaagaagaaggatccgacaccaaagccaaggaaactcagagagttctaaccgaaatcggcaaaaacaaagatacactaaaaaccggcatctggcaaaccgccggcgaaatgatcgccagcagacccaaaggagacgcgagaagaaacaagacagactcatacaaaaactcaatttcgcgggagctcctccaggacgaaaccaagatcatcttcgagaagcagcgggggatgaacagccaattcacaagtgcagacctagagaaggagtacagcgacatagcattccatcaagcccccatccaaagcatgctaaagatggtcggtggctgcacttttgaaaaagacgaggaaggcaagagactcaaacgcgcgccaaagaactcctacagcgccgaagtatttacagccctgacgaagataaataacctcgtcctcaaaacaaaaacagccaacatcaacgaccgtttcctcaccacagaagagagaaagaaagcgctggaactctgccattcaaacgccaaagtcacttttaaacagttacgaggggagctaggcctaccagaggactggatcttcaacaccgtggactatgctaagaaacccaagaaaaccgccgtcaaagaaacagagccagagagtgcatgcttctttcaaatgcgaggctacaacgaaataagaaaaagcgtcggaaaagacctatggacagaaatcagcatgaagaaagagatcttgaacagcatagttacaaccctcgcaacagagaaaagcgacgaagccatcaaagcccaacttaagaaatccgaagtaccagacgaaattgcagaaaaagtgctcggcctaaactttcgcggattcctacacctaagcatcaaagctctcgacaaaataatccccttcatgatggccggcgacaaatacaccgacgcctgcgacaaagccggatacaaagaacaaatcagcggcattaagaaaatattcctgcgaaaactaaacgacgaagaaaacgaacaaataacaaatcccgtcgcgaaacgggcaataacccagttccgtaaagtaatcaacgccataatacgcgaatacggcaaattcgaccagatgaacatcgaactggcccgcgacttggcaaaatcctacgacgaccgtaagaaaatcaaagaaggtcaagaggacttccgagccgaaaaagaccgcgcggcacaacggtgcaaagacaacggactagacccaaactccaaagacaatctctccaaatacagactatgggaacaacaagacaacgggttctgcatatactgcgggaaacccatagagctccaaagactagccgaacaaggctactgcgaagttgaccacattctcccctactcgcgatccctggacgactcccagcataacaaggtactcgcacacatacacgacaaccaacagaaaaagaaccaaatccccttcgaacacttcggcggcgacggcccaaaatgggaggagttcgtaggccgacttaacagccaattcaagaacctaccaaagagcaaactcaatcgactcgtcaagcgcaagttcgatgaaaaagacatggaaggattcaaggaaaggaacattaacgacacccgatacatcagcagattcatcaaaaacttcgtcgaaaaccacctcgagttcgccgaaagcgcccaaaagcaaaaggtattcgtccgctctggcagcctcacagccttcctacgccaccaatggggtctaataaagaaacgagacgaatccgaccgacaccacgcccttgacgcattagtcacagcctgcgcgacacaagccatggtcaaatcgaccgcaataaccgcccagaaaatggaatcctacaactggataaacaaagaaaaaccccgaatgcccctcccatggctcaacttcagagacgatgtccaaaagtcattggacgccgtcttcgtatccagagcaccccgacacaaagtaggaggagccgcccacaaggaaaccatccgctcaatccgaaagtgcggagaagagaaccttatcatcgagaaaacgccactggtcgatattgccacaaagagcggcatcaaactaaaagacatagagaaactctacaaaaaggaacaaaaccgaaagctctacgaaacactcaaagaacgcctcgaacaaaacggaaacgatccggttaaggcgttcggcaacccagacgaccccgtgcgaatgccgacaaacgacctaacaaaaacaggtccgatcataaaaagcatcaaactcatcacgaacaagaaatccgggctaaacgtaagagccggcatcgcggacaacggcgaaatcgcacgtctcgatgtctacgaacgaaagggaaaattctacctcataccaaactacgtcgccgacttcgccaacaaggagctaccgaagaaagcaatcaaagccaacaccccggaaacagaatggcccataatagaccgcaattacaactttaagttctcccttttcaaagacgacctcatcagcatcaaacaaaaactcgactccccagaggagttctactactacaaaggcccagacgtaagcaccgcaagcataacggtggaaagcgttgacagaaaaagactatgggaagagaaaaagaaaggaaaaatagaaaacgtcttccacacccgaatcggaacaaaaaccctcaagagcttccgcaagttcaacctggacatccttgggaccaaagcgccggtggaaatcaaaaaggaaacctgggtcggcgtcatacgcaagaacggcgtagccaacaacacaggcaacaaggcaatgtga

SEQ ID NO: 7349 - RNA, 3249 nt, synthetic construct
  misc_feature 1..3249: note = Cas9 variant
  source 1..3249: mol_type = other RNA
atggcagccttcaaacccaaccccatgaactacatcctaggcctagacataggtatcgcatcggtcgggtgggcaatggtcgaaatagacaaagaagaaaaccccatccgactaatcgacctaggagtacgggtattcgagcgcgcggaggtccccaagaccggagactccctcgccatggctcgacggcttgcccggtccgtacgtagattgacgcgccgacgagcgcacagactgcttagggcacgccgcctccttaagcgagagggtgttctccaggacgccgacttcgacgaaaacggacttgtcaagtcactccccaacacaccctggcaactacgggcagccgccctcgaccgcaagctgacgtgccttgaatggtcagcagtcctactacatctcataaaacaccgtggatacctctcccagaggaaaaacgagggcgaaactgcagacaaagaattaggcgccctcctaaaaggagtagcggacaacgcccatgctctccagacaggggacttcagaacgccagctgaactcgcactaaataaattcgaaaaggaatccggccacattcgaaaccagcgcggcgactactcgcatacgttcagccgcaaggaccttcaggccgaactaaacctactcttcgaaaaacaaaaggagttctccaatccacatgtatcagacagcctcaaggaaggcatagaaacactacttatggcacaacggccagcactgagcggcgacgccgtccagaaaatgctcgggcactgcaccttcgaaccggccgaaccaaaagcagcaaagaacacatacaccgccgaaaggttcatatggctaacaaaactaaacaatctaaggatcctagaacaaggatcggaacgaccactcaccgacaccgagagagccaccctcatggatgaaccataccgcaagagcaaactgacctacgcgcaagcccgaaagctcctcggtctcgaagacaccgccttcttcaaaggcctccgctacggaaaagacaacgccgaggcacccactttaatggagatgaaggcataccacgccatctcgcgagcactggaaaaagaggggctcaaagacaagaaaagcccactaaacctcagcacggagctacaagacgagatcggaaccgcattctcactcttcaaaaccgacaaagacatcactggccgcctcaaagaccgagtccagccggaaattctagaagcactgctaaaacacatctccttcgacaagttcgtacaaatatccctcaaagcacttagaagaatcgtccccctaatggaacaaggaaaaagatatgacgaagcatgcgctgaaatatacggcgaccactactgcaagaaaaacgccgaggagaaaatctacctaccaccgatcccagcagacgaaatcagaaatcctgtcgtcctaagagccctaagccaagcacgaaaagtaatcaactgcgtagtaaggcgctacggatctccagcgagaatccacatcgaaaccgcacgagaagtaggaaaatcgttcaaggaccgcaaagaaatcgaaaaacgccaagaagagaataggaaggaccgcgagaaagcggcggccaaattccgagaatacttccccaacttcgtgggagagcccaaaagtaaggacatcctcaaacttagactgtacgagcaacaacacggaaaatgcctatactccgggaaagagatcaacctcgtaagactcaacgaaaaaggctacgtcgagatagaccatgcattaccattctcacgcacatgggacgactcattcaacaataaagtcctggtactgggatcagaaaatcaaaacaaaggaaatcaaaccccatacgaatacttcaacggcaaggacaactcacgagaatggcaggagttcaaagcacgcgtagaaacttcccgcttccctcggtcgaagaaacagcgcatcctccttcagaaatttgacgaagaaggcttcaaagaacgcaacctaaacgatacacgatacgtaaatagattcctctgccaattcgtcgcagaccacatacttctaaccggaaaaggaaaacgccgcgtattcgccagcaacggccaaataacaaatctgctaagagggttctggggactcagaaaagtccgcgcggaaaacgaccgacaccacgcccttgacgcggtcgtcgtcgcctgcagcaccgtcgccatgcaacaaaagatcaccagattcgtacgatataaagaaatgaacgcgttcgacgggaaaaccatagataaagaaacgggggaagtactacaccaaaaagcacacttcccccaaccctgggagttcttcgcgcaggaagtaatgataagagtcttcggcaaaccggacggaaaaccagagttcgaagaagcagacaccccagaaaaactcagaaccctcctagcagaaaaactcagcagccgccccgaggcagtgcacgagtacgtaacacccctattcgtctcacgcgcaccaaacaggaaaatgagcggccagggccacatggaaacagtcaagtccgctaaacgcctcgacgaaggcatctccgtactaagagtacccctaacgcagctcaaactcaaaggtctcgagaaaatggtcaacagagaacgcgaacccaaattgtacgatgccctcaaggcccaactagaaacacacaaagataaccccgccaaagcattcgcagaacccttctacaagtacgacaaagccggcaacaggacccaacaggtgaaagccgtccgcatagaacaggtccaaaagaccggagtgtgggtcagaaaccacaacggcatagccgacaatgcaacgatggtgagagttgacgtattcgaaaaaggcggcaagtactacctcgtaccaatatacagctggcaagtggcaaaaggaatactacccgacagagcagtagtcgcattcaaagacgaagaagactggaccgtcatggacgactcctttgaatttcgattcgtactttacgcaaacgacctaataaaactaaccgcaaagaagaacgagttcctcggatacttcgtcagtctaaacagagcaacgggtgccatcgacatcagaacccacgataccgacagcaccaaaggcaaaaacggcatcttccaaagcgtaggcgtcaagaccgcactatcattccagaaaaaccagatcgacgagctcgggaaagagatccgaccctgccgactgaaaaagcgaccacccgtccgctga

SEQ ID NO: 7350 - RNA, 3249 nt, synthetic construct
  misc_feature 1..3249: note = Cas9 variant
  source 1..3249: mol_type = other RNA
atggccgccttcaaaccgaacccaatcaactacatactaggccttgacatcgggatagcgagcgtaggctgggctatggtagaaatagacgaagaagaaaaccccatccgactaatagacctaggggtacgcgtcttcgaaagggcagaggtgccaaaaacaggcgacagcctagcaatggcacggcgcctcgcgagaagcgtgagacgactaacgagaagacgcgcacaccgcttgctgcgggcacgaaggttattaaaacgagaaggcgtacttcaagcagccgacttcgacgaaaacggactaataaaatcgttacccaacactccctggcagctaagggcagcagccctcgaccgcaagctcaccccactcgaatggtccgccgttctgctacacctaataaaacacagaggatatctatcacaacggaaaaacgagggagagaccgcagacaaggagctgggagcgttgctgaaaggcgtcgccaacaacgcccacgcactccagacgggagacttccggacccccgccgaattagctttaaacaaattcgagaaagaatcaggccacatccggaaccaaaggggcgactactcacacaccttcagtcgaaaagacctccaagcggaactaatcctactcttcgaaaaacaaaaggagttcggaaacccccacgtatcaggaggcctaaaggaagggatagaaaccttgctaatgacccaacgcccagctctcagtggagacgcagtgcagaaaatgctggggcactgcaccttcgagccagcagagcccaaagccgccaaaaacacctacacggccgaacgattcatatggctcacaaaactaaacaacctacggatactggagcaaggatctgaaagacccctaacggacaccgaacgagccactttaatggacgaaccgtaccgaaaatcgaagctaacgtacgcgcaagcacgcaaactactagggctcgaggacacagcattcttcaaaggcctaagatacggcaaggacaacgccgaagcgtccacactgatggaaatgaaggcctaccatgccatatcccgcgccctggaaaaggagggcctcaaagacaagaaaagcccactgaacctctccagcgagctgcaagacgaaatcggcacagcattctccctgttcaaaacagacgaagacatcaccgggcgcctgaaagaccgcgtccaacccgaaatactagaggcactgctaaagcatatcagcttcgacaagttcgtccagataagcctaaaagcactacgaagaatagtccccctgatggaacaaggaaaacggtacgacgaggcttgcgcagaaatctacggcgaccattacgggaaaaagaacacggaggaaaagatctatctaccaccgatacccgccgatgaaataagaaaccctgttgtcctcagagcactctcccaagcaaggaaagtcatcaacggggtagtccgaagatacggaagcccggccagaatacacatcgagaccgcgagggaggtcggcaaatcattcaaggaccgcaaggaaatcgagaaaaggcaggaagaaaaccgcaaggatcgagaaaaggcggccgccaaattcagagaatatttcccaaacttcgtaggagaaccaaaatccaaagacatcctcaaacttcgcctctacgaacaacagcacggcaaatgcctgtactctggaaaggaaatcaacctcgtacgtctcaacgaaaaaggctacgtagaaatcgaccacgcactccctttctcccggacctgggacgactccttcaacaataaagtgctagtactcggttccgagaaccaaaacaaagggaaccaaactccttacgaatacttcaacggcaaagacaacagccgagagtggcaagagttcaaggccagagtcgaaacaagccgattcccccgaagcaagaaacaacgaatcctactccaaaaattcgatgaggacggcttcaaagagtgtaacctgaacgatacacggtacgtcaacagattcctatgccaattcgttgcagaccacatcctcctaaccggaaagggcaaacgacgggtattcgcaagcaacggacaaataactaacctcctccgaggattctggggcctgagaaaagtccgggccgaaaacgaccggcaccacgcactagacgccgtggtcgtcgcatgctccaccgtagcaatgcaacaaaagataacacgctttgtccggtacaaagagatgaacgcattcgacggaaaaacaatagacaaggaaaccggcaaagtactacaccagaaaacccacttcccccaaccctgggagttcttcgctcaagaagtgatgatccgtgtcttcggcaagccggacggcaaacccgagttcgaagaagcggacacaccagaaaaactgcgaaccctactcgccgaaaagctctcatcacgcccagaagcagtacacgaatacgttacacccctattcgtcagcagggcccccaacagaaaaatgtcgggacaaggacacatggaaaccgtcaagtcggcaaaaagactagacgaaggagtcagtgtactaagagtgccactcacgcaactcaaactgaaagacctcgaaaagatggtaaacagggaacgcgaacctaagttatacgaagccctcaaagcacgcctagaagcacataaagacgacccggcaaaagcgttcgcagaaccattctacaaatatgacaaagccggcaaccgaacacagcaagtaaaggcagttcgagtcgaacaagtccagaaaaccggagtgtgggtcaggaaccacaacggaatagcggacaatgcaacaatggtgcgagtggacgtattcgaaaaaggcgacaagtactacctagttcccatctactcctggcaagtcgcgaaaggcatactcccagaccgagcagtcgtacagggaaaagacgaggaagactggcaacttatcgacgacagcttcaacttcaaattttcacttcacccaaacgaccttgtagaggtcataacaaagaaagccagaatgtttggctacttcgcatcctgccaccggggcacaggcaacatcaacatcagaatccacgacctagaccacaaaatcgggaaaaacggcatacttgaaggaataggagtgaaaaccgcactgagcttccagaaataccaaatagacgagcttggaaaagaaatacgaccctgccgcctcaagaaacgacctcctgtaagatga

SEQ ID NO: 7351 - RNA, 3249 nt, synthetic construct
  misc_feature 1..3249: note = Cas9 variant
  source 1..3249: mol_type = other RNA
atggcagcgttcaaaccgaatccgataaactacatactgggactcgacatcggaatcgcatccgtcggctgggccatggtcgaaatagacgaagacgaaaatcccatatgcctcatcgatctaggcgtccgcgtcttcgaacgtgcagaagtccccaaaacgggcgactcactagccatggcacgaagactcgccagaagcgtaaggcgcctcacacgccgccgggcgcaccgcctgttacgagcacgcaggctgctaaaaagggaaggcgtactgcaagccgccgacttcgacgaaaacggccttatcaaatcactacctaacacaccctggcagcttcgagccgccgccctcgacagaaaactcactcccctagagtggagcgcggtcctgctacacctaatcaaacaccgcggatacctctcccagcggaaaaacgaaggggaaaccgccgacaaagaattgggagccctcctcaaaggggtcgccgacaacgcccatgcactacaaaccggcgacttccgaacccccgcagaactcgccctgaacaaattcgaaaaagaatcaggacacatacgaaaccaacgaggcgattactcacacaccttctcacgcaaagacctccaggccgaactaatcctcctattcgaaaaacaaaaagagttcggtaacccacacgtcagcggaggactcaaggaaggcatagaaactctactcatgacacaaagacccgcgctatcgggcgatgcggtccagaaaatgcttggccactgcacattcgaaccagcagaacccaaagcagcgaaaaacacctacacagcagaacgcttcatatggctaacaaaattgaacaacctcaggatcctagaacaaggatcggaaagacctttaaccgacaccgaacgagcaaccctcatggacgaaccgtaccggaaatccaaactcacatacgcacaagcaaggaaactgctaggtctagaagacaccgccttcttcaaaggactaagatacggcaaagacaacgccgaagcatcaacactcatggaaatgaaggcctaccacgctataagccgcgcattagaaaaggaagggctaaaggacaagaaaagcccgttaaacctcagtcccgagctccaagacgaaattggcacggccttcagtctattcaaaaccgacgaggacataaccggaagactcaaagaccgaatccagcccgaaatactagaagcactgctgaaacacatcagcttcgacaaattcgtgcaaatatcactgaaagccctccggcgtatagtaccccttatggaacagggtaaacgctatgacgaagcatgcgccgaaatatacggagaccactacggcaagaaaaacaccgaagagaaaatatacctaccaccaataccagccgacgaaataagaaacccagtcgtcctcagagccctctcgcaagcacggaaagtcatcaacggcgtagtacgcaggtacggcagcccagcccgtattcacatcgaaaccgcacgagaagtcggcaaaagtttcaaagaccgcaaggaaattgagaaaagacaggaagaaaatcgaaaggacagagaaaaggcagcagccaagttccgcgaatactttcccaacttcgtcggcgaaccgaaatctaaagacattttaaaactccggctctatgaacaacaacacggaaagtgcttatattccggcaaagaaataaacctaggacgactcaacgaaaaagggtacgtcgagatcgaccacgcactaccattctccagaacgtgggacgatagcttcaacaacaaagtcttagtcctgggcagcgaaaaccaaaacaaggggaaccaaactccatacgaatacttcaacggaaaagacaatagccgagaatggcaagagtttaaggcccgcgtcgaaacaagccgcttcccccgatccaagaaacaacgcatactgttacaaaaattcgacgaagacggcttcaaagaacgcaacctcaacgacacccgctacgtcaatcggttcctctgtcaattcgttgcagaccgcatgcgactcacagggaaagggaagaaacgcgtattcgcctccaacggtcaaatcacaaatctactgagaggcttctggggactccgcaaagtacgagctgagaatgacagacaccacgccctagacgcagtcgtggtcgcctgttcaaccgtagccatgcagcagaaaataacccgattcgtgcgatacaaggagatgaacgccttcgacggaaaaaccattgataaggaaaccggcgaggtcctccaccagaaaacccacttcccacaaccctgggagttcttcgcccaagaagtcatgatcagggtgttcggtaaaccagacgggaaacccgagttcgaagaagcagacaccccggaaaaactacgaaccctcctcgccgaaaaactatcctcccgcccagaagccgtccacgaatacgtcacccctctattcgtatcaagagccccaaatagaaagatgagcggacaaggacacatggaaaccgtcaagagcgccaaaagactggacgagggcgtcagtgttctcagagtaccgctcacgcaactcaagctcaaagacctggagaaaatggtaaaccgtgaacgagaaccaaagctatacgaagctctcaaagcacgactggaagcacacaaagatgaccctgcaaaagcgttcgccgaacccttctacaaatacgataaagcaggaaataggacacaacaagtcaaagcagtccgggtagaacaagtacaaaagacaggagtctgggtgaggaaccacaacgggatcgcggacaacgctaccatggtacgggtagacgtcttcgaaaaaggagataaatactacttagtgccaatatacagctggcaagtggccaaaggaatactcccagaccgagccgtcgtacaaggaaaagacgaagaggactggcagttaattgacgacagcttcaacttcaaattttcacttcaccccaatgacttggtcgaagtgatcacaaagaaagcgcgaatgttcggatacttcgcaagttgccaccgcggcacaggcaacatcaacatacgcatccacgatctcgaccataaaataggcaaaaacggaatcctcgaaggtatcggcgtcaaaaccgctctcagcttccaaaaatatcagatagacgagctaggagaagaaatccgcccctgccgcctaaagaaacgacccccagtgcgctga

SEQ ID NO: 7352 - RNA, 3249 nt, synthetic construct
  misc_feature 1..3249: note = Cas9 variant
  source 1..3249: mol_type = other RNA
atggccgccttcaaacccaatccaataaactacatcttaggactagacattggaatcgcgtccgtcggatgggcaatggtggaaatagacgaagacgagaaccccatctgcctgattgatctcggcgtgagagtattcgaacgcgccgaagtaccaaaaacaggcgacagcctggcgatggcccgacgcctagcacgaagcgtccgacgtctaacccgaaggagggcacaccgacttctccgcgcccgccgcctactcaaacgcgagggcgtgctccaagccgcggacttcgacgagaacggccttatcaaatcactcccgaacacaccctggcagctacgagcagccgccctggaccgaaagctgacgcccctagaatggagcgccgtactcctccacctcataaagcacaggggatatctaagccaacggaaaaacgaaggtgaaacagcagacaaggaactgggtgccctactaaagggcgtagcggacaatgcccacgcactacaaacaggcgacttccgcacccccgccgaactcgcactaaacaaatttgaaaaggagagcggccacatacgcaaccaaagaggggactatagccacaccttctcccggaaagacctacaggcagaattgattctcctattcgaaaaacaaaaagaatttggaaacccacacgtatcgggaggcctgaaggaaggcatagaaacgttactaatgacacagcggccggcactaagcggcgacgccgtacagaagatgctcggccactgcactttcgaaccagcggagccaaaagcagcaaagaacacatacacggccgaaaggttcatatggctcaccaaactaaacaacctccgcattctagagcaaggcagcgaacgcccactgacagacacggagagggcgacactaatggatgagccctacaggaaatccaaactaacctacgcccaagcccgaaaactccttgggctagaggacacagccttcttcaagggactgcgctacgggaaagacaacgcggaagcctccaccctaatggaaatgaaggcgtaccacgcgatctcacgcgcgctggaaaaggaaggactaaaagacaagaaaagcccactcaacctaagcccggaactacaagacgaaatcggaaccgcattcagcctattcaaaaccgacgaagacataaccggaaggctgaaagaccgaatccagccagaaatcctggaggcactactcaaacacatcagcttcgacaaatttgtacaaatatccctgaaagcgttaagacgcatcgtcccccttatggagcaaggcaagcgatatgacgaggcatgcgccgagatatacggagaccactacgggaagaaaaacaccgaagagaaaatctacctcccgcccatccccgcagacgaaataagaaacccagtcgtcctacgagcgctgagccaagcaagaaaggtcataaacggagtagtacgacggtacgggtcaccggcaagaatacacatagaaaccgcacgagaagtcgggaagtcgttcaaggatcgcaaagagatcgagaagagacaagaagagaacagaaaagacagagaaaaggccgccgccaaattccgggaatacttcccaaacttcgtcggggaaccaaaaagcaaagacatcctgaagctacgcctatatgagcagcaacacggaaagtgtctatattcagggaaagaaataaacctaggacgactcaacgaaaaaggttacgtcgaaatcgaccacgcgctccccttcagcagaacctgggatgacagcttcaacaacaaagtgctagtactgggcagtgagaaccaaaacaaaggcaaccagacaccatacgagtacttcaacggaaaagacaactcgagagaatggcaagagttcaaagcccgcgtcgaaaccagccgtttccctaggtccaagaaacaacgaatcctgctacagaaatttgatgaagacggcttcaaagaacgcaacctcaatgacacaaggtacgtcaacaggttcctatgtcagttcgtcgcagaccgcatgcgactcacgggcaaagggaagaaaagagtcttcgcaagcaacggacagataactaacctactcagaggcttctgggggctaagaaaagtgagagctgaaaacgaccggcaccatgcgctcgacgccgtagtggtagcatgctccaccgtagcaatgcaacagaaaatcacacgattcgtgagatataaagaaatgaacgctttcgacggaaaaaccatagataaagagaccggagaagtgctacatcagaaaacacacttcccgcaaccatgggagttcttcgcgcaagaagtaatgatacgcgtattcggaaaaccagacggcaaacccgaatttgaagaggccgacaccccagagaaactccgaacactcttagccgagaaactaagcagcaggccagaagcagtacacgagtacgtaaccccactcttcgtatcacgagcaccaaacagaaaaatgtcgggccaaggtcacatggagaccgtcaagtcagcaaagcgattggacgaaggtgtctcggtgctcagagtaccactaacacagttaaaactgaaggaccttgagaaaatggtaaaccgcgaacgagaacccaaactctacgaagccctaaaggcacgccttgaagcccataaagacgaccctgccaaggccttcgctgaaccgttctacaagtacgacaaggcagggaaccgaacacaacaagtaaaagccgtacgagtagagcaagtacagaaaacgggagtatgggtaagaaatcacaacggaatagccgataacgcgacaatggtaagggtagacgtcttcgagaaaggagacaagtattacctggtcccaatatacagctggcaagtagcaaaaggcatcctacccgatcgagccgttgtgcaaggaaaagacgaggaagactggcaattaatagacgacagcttcaactttaaattctcactccatcccaacgacctcgtagaagtgataacgaagaaagcccgaatgtttggctacttcgccagctgccacaggggaacgggaaacataaacattcgcatccatgacttggaccacaaaatagggaaaaacggaatactcgaaggaatcggagtgaaaaccgccctatctttccaaaaataccaaattgacgaacttgggaaagaaatccgaccctgccggctaaagaaaagaccgccagtgcgatga

SEQ ID NO: 7353 - RNA, 3249 nt, synthetic construct
  misc_feature 1..3249: note = Cas9 variant
  source 1..3249: mol_type = other RNA
atggccgcgttcaaacctaacccgatcaactacatcctaggcttggacattggaatcgcatccgtcggatgggcaatggtagagatcgacgaagacgaaaaccccatatgcctaatagacctaggagtacgcgtgttcgagagggcagaagtgcccaaaaccggcgactcactcgccgccgcacgacgcctcgctagaagtgtcagacggctaaccaggaggcgcgcgcaccgactactccgagcccgccggctactcaaacgagagggcgtcctccaggccgccgacttcgacgaaaacgggctaataaaatcactcccgaacacgccatggcaactccgtgcagccgcactagacagaaagctaaccccactagagtggtcagccgtactcctacacctaataaaacaccgcggatacctctcccagagaaagaacgagggcgagacggcagacaaagaactaggagccctattgaaaggagtcgcagataatgcccatgccctacaaacaggggactttcgaactcccgcagaactcgccctcaacaaattcgagaaagaaagcggccatatacggaaccagcgcggagactacagccacaccttcagtcgaaaagacctccaagcagagctaatactcttatttgaaaaacaaaaagagttcggaaacccacacgtaagcggcggcctgaaagaaggcatagaaactctcctaatgacgcagagacccgccctatcaggcgacgccgtccaaaagatgctcggtcactgcacgttcgaacctgccgaacccaaagccgcgaagaacacttacacagccgaaagattcatatggctgacaaaactgaacaacctcagaatactagaacagggcagtgaacggccactgaccgacaccgaacgcgccacactcatggacgaaccgtaccgcaaatcgaagctgacctacgcccaagcccgaaaattgctcggactcgaagacacagcgttcttcaaagggctgcggtatggaaaagacaatgccgaagcatccaccctcatggagatgaaagcgtaccacgccatcagccgcgccctagaaaaggagggcctgaaagacaagaagtcgcccttaaacctatctccagaactccaggacgaaatcggaacggccttctcactattcaagacagacgaagacataacaggacggctaaaagaccgagtgcaaccagaaatccttgaggccctgctcaaacacattagtttcgacaaattcgtacaaatatcactaaaagccctcaggcgcatagtcccgctaatggaacaaggaaaacgctatgatgaagcgtgcgccgaaatatacggcgaccactacggaaagaaaaacacagaggagaaaatatacttaccgcccataccagccgacgaaatccgcaaccccgtagtacttcgagccctgtcccaagccagaaaagtaataaacggggtcgtccgccggtacggatcaccagccagaatacacatagaaacagcacgcgaggttggaaagagcttcaaggaccgcaaagaaatcgaaaaacgccaggaagagaaccggaaggatcgcgaaaaggcagcagcgaaatttcgagaatacttccccaacttcgtgggcgagcctaagagcaaggacatactcaaacttaggctctacgaacaacagcacggcaagtgtctctactcgggcaaggaaatcaacctgggacgactcaacgaaaaaggctatgtagaaattgatcatgcactgcccttctcacgaacatgggacgactccttcaacaacaaagtcctagtactagggtccgaaaaccaaaacaaagggaaccagacgccgtacgaatacttcaacggaaaagacaactcacgagagtggcaagagttcaaagcaagggtagaaaccagtagattcccccgctcgaagaaacaaagaatcctgctacaaaaattcgacgaagacggattcaaagaaagaaacctaaacgacaccaggtacgtaaaccgcttcctatgccaatttgtagcagaccgcatgcgtctcaccggcaaagggaagaaaagagtgttcgcatccaacggccaaataaccaacctactaagaggattctggggactacggaaagtacgcgcggagaacgaccgacatcacgccctcgacgccgtcgtagtagcgtgcagcacagtagcgatgcaacagaaaataacccgatttgtgcgctacaaagaaatgaacgcgttcgatggcaaaacgatagacaaagaaacaggagaagtcctacaccagaaaacacacttcccacaaccatgggagttctttgcccaagaagtaatgatccgcgtcttcggcaaacccgacgggaaaccagagttcgaagaagcagacaccccagaaaagctgaggacacttctcgcagaaaagttaagctcccggccagaagcagtacatgaatacgtaacaccgcttttcgtaagccgagcacccaaccgaaagatgtccggacaaggacacatggaaacagttaaatcggccaagcgactagacgaaggcgtcagcgtactccgcgtcccgctgacgcaattgaaactaaaggacctcgagaaaatggtgaatcgcgaacgcgagcccaaactctacgaagcactcaaggcccggcttgaagcccacaaagacgatccagccaaggcattcgcagagccattttacaaatacgacaaagcgggaaacagaacccaacaagtcaaagctgtaagagtagaacaagtacaaaagactggcgtatgggtccgaaaccacaacggcatagccgacaacgctaccatggtaagagtagatgtcttcgaaaaaggcgacaaatactacctagtaccgatctacagctggcaagtggccaagggtatcctaccagatagggccgtagtgcaggggaaagatgaagaggactggcaattaatcgatgacagcttcaacttcaagttctccctgcaccctaacgatctcgtcgaagtcatcaccaagaaagcgcgcatgttcggctacttcgccagctgccaccgcggaaccggaaatataaacatccgtattcacgacctagaccacaaaatcgggaaaaacggcatcctagaaggaatcggggttaaaacagccctcagcttccagaagtaccagatcgacgaactaggcaaagaaatccgaccctgccggctaaagaagcgacccccggtgcgctga

SEQ ID NO: 7354 - RNA, 3249 nt, synthetic construct
  misc_feature 1..3249: note = Cas9 variant
  source 1..3249: mol_type = other RNA
atggccgccttcaaacccaacccaatcaactacatactcggactagacatcgggatcgcaagcgtaggctgggcgatggtagaaatagatgaagaggaaaacccaatacggctaatagacctaggagtacgcgtcttcgaacgggcagaggtacccaaaacgggcgacagcctcgcgatggcgcggcgactcgcgcgcagcgtacggcgcctcacgcgccgccgcgcccaccgcctactccgaaccagaagactactcaaaagagaaggcgtactccaagccgctaatttcgacgaaaacggcctcatcaaaagcctgccgaacaccctatggcaactcagggcagccgccctggacagaaaactaacacccctcgaatggagcgccgtcctgctgcacctcataaaacaccggggatacctatcccaacgcaaaaacgaaggagaaacagcagacaaagagctcggagcactcctcaaaggagtcgcaggcaacgcccatgccctacaaaccggagactttaggaccccggccgaactggccctgaacaaatttgaaaaagaaagtggacacataaggaaccagcgcggcgactatagtcacaccttctcacgcaaggacctgcaagcagagttaaacttacttttcgaaaagcagaaagagttcggcaacccacacatcagcgacggcctcaaagaaggcatcgaaacactgctaatgacacaaagacctgccctctccggagacgcagtccagaaaatgctaggccattgcacattcgaacccacggaaccaaaggcagccaagaacacctacacgacagaacgattcatatggctcacaaaactcaacaacttaaggatattagaacaaggaagcgaacgcccactcacagacaccgaacgcgccacgctcatggacgaaccctacagaaaaagtaagctgacctacgcccaagcccgaaaactactagagctagacgacatagcattcttcaagggactgcggtacggcaaagacaatgcggaggccagcacgctaatggaaatgaaagcctaccacgcgatctccagagccctcgagaaagaaggcctaaaagacaagaaaagccccctgaatctctcaccagaactacaagacgaaatcggcaccgcatttagtctatttaaaacagacgaagatattaccggccgactcaaagaccgaatacaaccagaaatactcgaggccctgctcaagcacataaatttcgataagttcgtccaaataagcctgaaagcgctccggcggatagtgcccttaatggaacaaggaaaacggtacgacgaagcatgcgccgaaatatacggggaccactacggcaagaaaaacaccgaagagaaaatcgacctcccgccaattcccgcggacgaaatacacaaccccgtcgtcctcagggcactatcccaagcaagaaaggtcataaacggcgtcgtacgaagatacggcagcccggcccggatacacattgaaacagccagagaagtcggcaaatcattcaaagaccgaaaagaaattgagaaaaggcaagaagaaaaccgaaaagacagggaaaaagcggcggcaaaattcagagaatacttccccaacttcgtcggcgagccaaaatcaaaggacatcctaaagctaagactctacgaacaacagcacggcaagtgtctctattcaggcaaagaaattaacctagggcgactaaacgaaaaagggtatgtcgaaatagaccacgctctgccattcagcaggacatgggacgactcctttaacaacaaagtcctagtgctcggaagcgaaaaccaaaacaagggcaaccaaacaccatacgaatacttcaacggcaaagacaacagccgggaatggcaagagttcaaagcacgtgtggaaacctcccgcttcccccggagcaagaaacaacgaatactcctccagaaattcgacgaagatggattcaaagaacggaacctaaacgacacacgctacgtaaaccgattcttatgccagttcgtcgccgacaggatgcgcctgaccgggaaaggtaagaagagggtcttcgcgtcaaacggccagataacgaatctactaagaggattctggggactccgtaaggtcagagcggagaacgaccggcaccacgcactggacgcagtcgtagtagcctgctccacggtcgccatgcaacagaaaataacacgattcgttcgctacaaagagatgaacgcattcgacgggaagacaatcgacaaagagacaggagaagtactacatcagaaaacacacttcccacaaccttgggagttctttgcccaggaagtcatgatccgcgtattcgggaagcccgacggcaaaccagagttcgaagaagccgacacccccgaaaagctgaggacactgctgacggaaaaactctcatcacgcccggaagccgttcacgaatacgtgacacccctcttcgtgtcaagggcacccaaccgaaaaatgtcaggacaagggcacatggaaaccgtaaagtccgcaaaaagactagacgagggcatctcagtcctcagagtaccgctaacccaactaaaactaaaagaccttgagaaaatggtcaaccgtgaacgagaaccaaagctgtacgaagccttaaaggcaaggctagaggcacacaaagacgaccccgcgaaggctttcgccgaaccattctacaaatacgataaagccggcaacaggacacaacaagtgaaagcaatgagggtagaacaagtacaaaagaccggagtctgggtccgcaaccacaacggaatcgccgacaatgcaaccatggtacgagtggacgtcttcgaaaaaggcgacaaatactacctcgtcccaatctactcttggcaggtcgccaagggcatcctgccggatagagccgtagtacaaggcaaagatgaagaagactggcaactaatcgacgactccttcaacttcaagttcagccttcaccccaacgacctagtagaagtcatcactaaaaaggcccgcatgttcggatactttgcaagctgccaccgaggcaccggcaacataaacatcagaatacacgacctggaccacaagataggcaaaaacggaatactagaaggcataggagtaaagaccgcattgagcttccaaaagtatcaaatagacgaattaggcaaagaaatcagaccctgcaggctaaagaaacgcccgcccgtaagatga

SEQ ID NO: 7355 - RNA, 3249 nt, synthetic construct
  misc_feature 1..3249: note = Cas9 variant
  source 1..3249: mol_type = other RNA
atggccgccttcaaacccaaccccataaactacatattgggactagacataggcatagcgtcagtgggatgggccatggtggaaatagatgaagacgaaaatcctatctgcttgatcgacctcggcgtaagagtcttcgagcgcgctgaagtgccgaagaccggggacagcctcgccatggcaagacgactcgcaagatcggtccgccgactaacgcggcgacgcgctcaccgcctcctccgcgctcgaagactgctaaaacgagagggcgttttacaagcggcggacttcgatgagaacggactcataaaaagcctcccgaacacaccctggcagttacgcgcggccgcgctcgaccgaaaactcacgcccctcgaatggagcgcagtcctgctccaccttataaagcaccgcggatacttatcacaacgcaagaacgaaggcgaaacagcagacaaagagctgggcgcactcctgaaaggcgtcgccgataacgcccacgcgctacaaaccggcgacttcaggacacccgctgaactcgcactcaacaaatttgaaaaagagagcggtcacatccgaaaccaaaggggcgactactcgcacacattcagtcgcaaggacctccaagccgaactaaacctcctcttcgaaaaacaaaaggaatttggcaatccgcacatctcggatggcctcaaagagggaatagaaaccctcctaatgacacaacgaccggccctgtcaggagacgccgtccagaaaatgctcggacactgcacattcgaaccagcggaacccaaagccgccaagaacacatatacagccgaacgcttcatatggctaaccaagctaaacaaccttagaatattagaacaaggctcagaaaggccattaacagacaccgagcgaactactctgatcgacgagccatatagaaagagcaaactcacctacgcccaggcaagaaaacttctcgaactagacaacaccgcattcttcaaaggcctacgctacggcaaagacaacgcagaggcaagcactctcatggagatgaaagcataccacgccatcagcagagcccttgagaaagaaggcctcaaagacaagaaatcgcccttaaacctgtcacccgagctccaggacgagatcggcaccgccttcagcctcttcaaaacagacgaagacataaccggacggctcaaagacagggtacaaccagaaatactcgaagccctactcaagcacataagttttgacaagttcgtccaaataagcctcaaagccctaagaagaatcgtccccctcatggaacagggaaagcgctacgacgaggcctgtgccgagatctacggggaccattacgggaagaaaaacaccgaagagaaaatcgatctacccccgatacccgccgacgagatcaggaacccggtcgtcctgcgcgcactaagtcaagcacgaaaagtgataaacggcgtggtgagacgatacggctcaccagcacgaatacacatagagacggcacgagaagtcggcaaatccttcaaggaccgaaaagaaatcgaaaaacgccaagaagaaaacagaaaagaccgagagaaagccgccacaaaatttcgcgagtatttcccaaactttgtcggcgaacccaagtccaaggacatactcaaacttcgtctgtatgaacagcaacacggaaaatgtctgtacagcggaaaagaaataaacctgggaaggctgaatgaaaaaggatacgtcgaaatagatcacgcactccccttctcccgaacttgggacgacagcttcaacaacaaagtcctcgtattaggctccgaaaaccaaaacaaaggaaaccaaacaccctacgaatacttcaacggcaaagacaacagtcgagagtggcaagagttcaaagcccgagtagaaacgagcagattcccacgcagcaagaaacaacgaatactcctacaaaaattcgacgaagaaggcttcaaagaaaggaacctaaatgacacgcgatacgtcaaccgattcctatgccaattcgtcgccgaccacatgttactcaccggcaaaggcaaaagaagggtcttcgccagcaacggtcaaatcaccaacctactcagaggcttctggggcctaaggaaagtccgagccgaaaatgacaggcaccatgccctggacgccgtggtagtcgcatgcagcacagtggccatgcaacaaaagatcacccgcttcgtaagatataaagaaatgaacgcctttgacggcaaaactatcgacaaagaaacaggcgaagtactacaccagaaaacacactttccccaaccttgggagtttttcgcccaagaagtaatgatcagagtattcggcaagcccgacggaaagccagagttcgaagaagcagacacccccgaaaagctacggaccctactcgctgaaaaactcagcagcagaccagaagccgtacacgaatacgtcaccccactcttcgtatcccgagcacccaaccgcaagatgtcgggacaagggcacatggaaacggtcaagagcgcaaagagactcgacgaaggagtgtccgtactcagagtcccgctgacgcaactcaaacttaaagatctcgagaaaatggtaaaccgcgaacgtgaaccaaaactctacgaagccctcaaagccagacttgaagcccacaaggacgacccagcgaaagcattcgcggaaccattctacaaatacgacaaggccgggaaccgaacgcaacaagtcaaagccgtgcgagtcgaacaagtccagaagaccggtgtctgggtccgaaaccacaacggcatagcagataacgccaccatggtgcgggtagacgtattcgaaaaaggagacaaatactacctcgtccccatctatagctggcaagtagcaaaaggcatcctcccagaccgagccgtagtccaaggaaaggacgaagaagactggcaactaatcgacgactccttcaacttcaaattcagccttcacccaaatgacctagtcgaagtgatcaccaagaaagctcgcatgttcggatacttcgccagctgccaccggggcacggggaacatcaacatcaggatccacgacctcgaccacaaaatcgggaaaaacggaatcttagaaggcatcggcgtcaaaaccgcactcagcttccaaaaatatcaaatcgacgaacttggaaaagaaataaggccctgcaggctgaagaaacggccacccgtccgctga

SEQ ID NO: 7356 - RNA, 3249 nt, synthetic construct
  misc_feature 1..3249: note = Cas9 variant
  source 1..3249: mol_type = other RNA
atggccgctttcaaaccgaacccgatgaactacatcctcggcctagacatcggaatagcttcggtcggatgggcaatcgtcgagatagacgaggaagagaacccgatcagacttatcgatctaggagttcgtgtcttcgaacgagcagaagtgccaaaaacaggagactcactcgccgccgcgcgacgactagcccgaagcgttcggaggctgacccgccggagagcccatcgacttctgcgcgcacgacgcctccttaaacgagaaggcgtcctgcaagccgcagacttcgacgagaacggactcataaaaagcctcccgaacacaccgtggcagctacgcgcggcggcactagaccgcaaactcactcccctagaatggagcgctgtcctcttacacctaatcaaacatcggggctacctgtcacagcgcaagaatgaaggcgaaaccgccgacaaagaactaggtgcgctgctaaagggcgtagccgacaacacacacgccctccaaactggagacttccggacgcctgcagagctggcactgaacaaattcgagaaagaaagcggacacatcagaaaccaacgcggagactactcacataccttcaacaggaaagacctgcaagccgagctcaacctcctattcgaaaaacagaaggagttcggaaacccccacgtctcagacggtctaaaagaaggaatcgaaacgctactaatgacgcaaagaccagccttatccggagacgcagtacaaaagatgctagggcactgcacattcgaacccacggaacccaaggccgccaagaatacatacaccgctgaacgcttcgtatggctcacaaaactcaacaacctgcgcattctagaacaaggcagcgaacgacccctgacggatacggaacgagcaaccctcatggacgaaccctaccgcaaaagcaagttaacatacgcccaagctcggaaactcttagacctcgacgacacagcgttcttcaaagggctgagatacggcaaagacaacgcggaagcaagtaccctcatggaaatgaaggcctaccacgccataagccgagcacttgaaaaagaaggactaaaggacaagaaatcacccctcaatctcagtccagaactccaggacgagatcggaacagcattctccttattcaaaacagatgaagacatcaccgggcgactaaaagatcgtgtccaacccgaaatactagaagccctgctaaaacacatctccttcgacaaatttgttcagatcagcctcaaagcactcagacggatcgtacctctcatggaacagggaaacagatatgacgaggcatgcacagaaatctacggagaccactacggaaagaaaaacaccgaggagaaaatttacctacccccgataccggccgacgaaatccgaaaccccgtagtactccgagcactgagtcaagcccgcaaagtcatcaacggcgtggtcagacgatacggatctcctgcaagaatacatattgaaaccgcccgagaagtaggaaaatccttcaaagatcgaaaagaaatagaaaagaggcaagaagagaaccgcaaagacagagagaaatcagcagcaaaatttcgagagtatttcccaaatttcgtgggggaaccaaaaagcaaagacatactcaagctccgtctctacgaacagcagcatggcaagtgcctctactcgggcaaagagataaacctcgggagactaaacgagaaagggtacgtagaaatcgaccacgcgctgcccttctccagaacctgggatgacagcttcaataacaaagtcctcgcattaggcagcgaaaatcagaacaagggcaaccaaaccccatacgaatactttaacggcaaagacaactcccgagaatggcaagaatttaaagcgcgggtcgaaacgtcccgattcccccgcagcaagaaacagcgcatcctcctacaaaaattcgacgaagacgggtttaaagagcgaaacctcaacgacactcgttacatcaaccgctttctatgccagttcgtggccgaccacatgctactgacaggcaaaggcaaaagacgggtgttcgcatcaaacggacaaataactaacttactacggggcttctggggactccgaaaagtacgcgctgagaacgaccgacaccacgcactcgacgcagtggtcgtcgcgtgctcaacaatagcgatgcaacagaaaattaccagattcgtccgatataaagaaatgaacgccttcgatgggaaaaccatcgacaaagaaacaggagaagtcctccaccaaaaagcccacttcccacaaccctgggagttctttgcccaagaagtaatgatacgcgtcttcggcaaacccgacggcaaaccggagttcgaagaagcagatacccccgaaaaactgcgaacactcctagcggaaaaactcagcagccgaccagaggccgtacacaaatacgtcacacccctattcatatccagagcacccaacagaaaaatgtcgggccaaggacacatggaaactgtaaaatcagcgaagaggctcgatgaaggaatatccgtcctcagagtgcctctaacacaactgaagctaaaagacctcgagaaaatggtaaaccgagaacgagaacccaaactgtatgaagccttaaaagcccggctagaggcacacaaggacgaccccgccaaagccttcgccgagccgttttacaaatacgacaaggcgggcaaccgaacccaacaagtaaaagccgtccgggtcgaacaggtacagaaaacgggcgtatgggtacacaaccacaacggcatcgccgacaatgccacaatagtgagagtcgacgtcttcgaaaaaggcggaaaatactacctagtaccaatctattcatggcaagtagcaaaaggcattctgcccgacagggccgtcgtacagggaaaagacgaagaagactggacggtaatggacgactctttcgagttcaaattcgtgctctacgcaaacgacctaatcaagctcaccgccaagaaaaacgaatttctgggatacttcgtgagcctcaaccgggcaaccggagcaatcgacatccgaacccacgatacggactcgaccaaaggtaaaaacgggatcttccaaagcgtaggagtcaaaaccgccctctcattccaaaaataccaaatagacgaactaggcaaagagatccggccctgcagactcaagaaacgacccccggtccgctga

SEQ ID NO: 7357 - RNA, 3249 nt, synthetic construct
  misc_feature 1..3249: note = Cas9 variant
  source 1..3249: mol_type = other RNA
atggcggccttcaaacccaactccataaactacatattaggcctcgacataggcatagcgagtgtaggatgggccatggtcgagatagacaaagaggagaacccaattcgactgatagacctgggcgtacgcgtcttcgaacgggcagaggtcccaaaaaccggagacagtctagcagcggcccgcagactcgcgcgtagcgtccgacgtttaacaagaagaagggcccaccgactactccgcactcgccggctcctcaaacgcgaaggcgtcctgcaagcagcaaacttcgacaaaaacgggctcatcaaaagcctgccaaataccctatggcagcttagagcagcggccctggatcggaaactgacaccactagaatggagcgctgtcctactccacctgataaagcacaggggatacctctcacaacgcaaaaacgaaggtgaaaccgcagacaaagaacttggagccctcctcaaaggcgtcgccggaaacgcgcacgccctccaaaccggagacttccgcacacccgcagaactagccctgaacaaattcgaaaaagagtccggacatatccgaaaccaaagaggagactactcccacacattctcgcgcaaagatctccaagcggaactcaacctcctatttgaaaagcaaaaagagttcggcaacccacacatttccggtggcctcaaagaaggcatcgaaacactcctgatgacacaacggcccgccctatcaggggacgccgtccagaaaatgctaggacactgcacgttcgaacccaccgaaccaaaagccgctaaaaacacctataccacggaacgattcatctggctaacaaaactcaacaacctgcgaatcctagagcaaggtagcgaacgcccactcacggacacagaacgggccacgcttatggacgagccatatcgcaagtcaaaactaacctatgcacaagccaggaaactcctgtccctagaggacacagcattcttcaaaggactccgctacggcaaagacaacgccgaagccagtacactaatggaaatgaaggcctaccacaccatctcacgcgcactagaaaaagaaggcctaaaagacaaaaagtcaccactcaacctttcacccgagctccaagacgaaatcggcacggcatttagcctgttcaaaaccgacgaagacatcaccggccgtcttaaggatcgtatacaaccagaaatcctcgaagccttactaaaacacatcagcttcgacaaattcgtacaaatcagcctaaaagctctccgcagaatagtccccctgatggaacaaggtaaaagatacgacgaagcctgcgcggaaatctacggagatcactacggaaagaaaaacacagaagagaaaatctacctacccccaatacccgccgacgagatacgcaaccccgtagtcctccgcgccctttcacaagcccgcaaggtaataaacggtgtcgttcggcgatacgggagcccagccaggatccacattgaaaccgcgcgcgaggtcggaaagagtttcaaagaccgaaaagagatagaaaaacgtcaagaagaaaaccgaaaagacagggaaaaagccgcagcgaaattccgggaatacttccccaacttcgtcggagagcccaagagcaaagacatcctaaaactacgcctgtacgaacaacaacacggcaaatgcctatactccggtaaagaaatcaacctagtccgactcaacgaaaaaggatacgtcgaaatagaccatgcccttccgttcagccgaacctgggacgacagctttaacaacaaagtcctcgtactcgggagcgaaaaccaaaacaaaggaaaccaaacgccttacgaatacttcaacggcaaggacaacagccgagagtggcaagagttcaaagcaagagtcgaaacaagccgattcccccgaagcaaaaagcaacgaatactactacaaaaattcgacgaggatgggttcaaggaacgaaacttaaacgacacccgatacgtgaaccgcttcctatgccaattcgtcgcggaccatatactactcacaggtaaagggaaacgtagggtcttcgcctccaacgggcaaatcaccaacctccttcggggcttctggggcctacgaaaagtccgggcagaaaacgaccgacaccacgctctggacgcagtcgtcgtggcatgcagcacagtcgccatgcaacagaagataacacggttcgtacgatacaaagaaatgaacgcgttcgatggaaaaacgatagataaagaaaccggcgaagtcctacaccagaaaacccacttcccacaaccctgggagttctttgcccaagaagtaatgatccgagtcttcggcaagcccgatggcaaacctgagttcgaagaagcggacacgctcgaaaaactccgcaccctactcgcagaaaaactaagctcgcgacccgaagcagtacacgaatacgtaaccccattatttgtatcacgcgcccccaatagaaaaatgagtggccaaggtcacatggaaacagtcaagagcgcgaaacgactagatgaaggcgtctcggtactccgagtgcccctcactcaactaaaactgaaagatctagagaaaatggtgaatagagaacgagaacccaaactgtacgaagcactcaaggcgaggctagaagcccacaaggatgacccagcgaaagccttcgccgaacccttctacaagtatgacaaagcaggtaaccgaacacagcaggtaaaagcggtccgcgtagaacaagtccaaaagactggggtgtgggtacgtaaccacaacggtatagcagataacgcaacaatggtccgcgtcgacgtcttcgaaaaaggcgacaaatactacctcgtgccgatctactcctggcaggtagcaaaaggaatcttaccagaccgcgcggtcgtacaaggaaaagacgaagaagattggcaactcatcgatgactcattcaacttcaagttctcgctacacccgaatgacctcgtagaagtcataaccaagaaagcgcgaatgttcggatacttcgcaagctgccaccgcggcacgggaaacataaacatccggatacacgaccttgaccacaaaatcggcaaaaacggaatactagagggaataggcgtaaaaacagcgctcagctttcagaaataccagatcgacgaacttggaaaagaaatccgtccttgcaggctcaaaaagcggcctccagtcaggtga

SEQ ID NO: 7358 - RNA, 3249 nt, synthetic construct
  misc_feature 1..3249: note = Cas9 variant
  source 1..3249: mol_type = other RNA
atggcagccttcaaaccaaaccctataaactacatacttgggttggacatagggattgcaagtgtaggctgggcaatggtcgaaatagacgaggaagaaaaccctatacgcctcatagacctgggcgtcagagtattcgaacgagcagaagtacccaaaaccggggactccctggccatggtgcggagactcgccaggtcagtacgcagactaacaaggagacgagcccacaggctactacgcgctagacgcctactaaaacgcgaaggcgtcctccaagccgcagacttcgacgaaaacggcctaattaaatccttaccaaacacgccatggcaactccgcgccgcagcactcgaccgaaagttaacgccactagaatggagcgcagtcctcctacacctcattaaacaccggggctacctcagccagcgcaaaaacgagggagaaaccgccgacaaggaactcggtgccctcctaaagggtgtcgcggacaacgcacacgccctccaaacaggagacttcaggacccctgcagaactggccctcaacaaatttgaaaaagaaagcggccacatccgcaaccagcgcggagactatagccacacattctcccgaaaagatctccaagccgaactaatactcctgttcgaaaaacaaaaagagttcggaaacccccacataagcggcgggctcaaggaaggtatagaaacgctactcatgacacagcgtccagcgctaagtggagacgccgtgcagaaaatgctcggccactgcacgttcgaacccgcagaaccgaaagccgcgaaaaacacatacaccgcggaacgattcatctggctaacgaaactcaacaacctccgtatcctcgaacaaggcagcgagcgcccattaactgacaccgaaagagccaccctcatggacgaaccataccgcaaatcgaaactgacctacgcacaagccagaaaacttctcggactcgaggacacggcatttttcaaaggactacgctacggcaaagacaacgcagaagcctccaccctgatggagatgaaggcctatcacgccatttcgcgcgcgctcgaaaaagaaggcttgaaagacaaaaagtccccgttgaacctaagtcccgaactccaggacgaaatcggcacggcattcagcttattcaaaaccgacgaggacattaccggccgccttaaagaccgcatacaaccggagatactcgaagctctcctgaaacacattagcttcgacaaattcgtacagatcagcttaaaagcgctccgaagaatagtccccctcatggaacaaggcaaaagatacgacgaggcatgcgctgaaatatacggcgatcactacgggaagaaaaacaccgaagaaaagatatacctaccacccatacccgccgacgaaatccgaaaccccgtagtactccgagccctcagccaagcccgaaaagtcatcaacggagtagtgcgcagatatggctccccagccagaatccacatagaaacagcacgtgaagtcggaaagagcttcaaagatcgaaaagagatagagaagcgacaagaggaaaaccgaaaagaccgcgaaaaagcagcagccaagttccgcgagtactttccaaacttcgtgggcgagcccaaatcaaaagacatcctaaaactgcgactatacgaacaacaacacggcaaatgtctctacagcggaaaggaaataaacctaggccgactcaacgaaaaagggtacgtcgagatcgaccacgcactaccattctcaaggacctgggacgactccttcaacaacaaagtcctcgttttaggctcagaaaaccaaaataaagggaaccaaacgccctacgaatacttcaacggcaaggacaactcacgcgagtggcaagagttcaaagctcgcgtagaaactagccgcttcccacggtcaaagaaacaaaggatcttgctccagaaattcgacgaagacggcttcaaagagcgcaatctcaacgacactcgctacgtcaaccgatttctctgccagttcgtagccgatcgcatgaggctaaccggcaaaggcaaaaagcgtgtcttcgcgagcaacggacaaatcaccaatcttctaaggggattctgggggctgcgcaaagtaagagctgagaacgaccgacaccacgcactcgacgcagtcgtagttgcgtgctccaccgtcgcgatgcaacaaaagataacccgcttcgtccggtacaaagaaatgaatgctttcgatggcaaaaccatcgacaaagaaacgggcgaagtcctacaccagaaaacccacttcccccaaccgtgggagttcttcgcacaagaagtcatgatacgggtcttcggcaaacccgacggcaagcccgagttcgaagaagccgacacaccggaaaaattaagaaccctcctcgcagaaaaactaagctccagacctgaagcggtgcatgaatacgtcacgccgctctttgtctctcgtgcgcccaaccgcaagatgtccggccaaggccatatggaaaccgtaaaaagcgccaaacgactcgacgaaggcgtaagcgtcctacgggtaccgctaacccagctcaaattaaaagaccttgaaaagatggttaaccgcgaacgagaacccaagctctacgaagcccttaaagcccgcctggaagcacacaaagacgacccggccaaggccttcgccgaacccttctacaaatacgacaaagcaggcaacagaacccaacaagtaaaagccgtacgcgtcgaacaagtccagaaaaccggcgtgtgggtacggaaccacaacgggatagccgacaacgcaacaatggtaagggtcgacgtctttgaaaaaggagacaaatactacctagtcccgatatacagctggcaagtcgcaaaagggatcctcccagaccgagcagtcgtacaaggaaaagacgaagaagactggcaactcatcgacgactctttcaacttcaaattcagcctacaccccaatgatttagtcgaagtaatcactaaaaaggcaagaatgttcggatatttcgcaagctgccaccgcggcaccggcaatatcaatatccgaatacacgaccttgaccacaaaatagggaagaacgggatactcgaaggaatcggcgtcaaaaccgcactctcatttcaaaaataccaaatagacgaactaggaaaagaaatcagaccctgccgactcaaaaagcgaccacccgtacggtga

SEQ ID NO: 7359 - RNA, 3249 nt, synthetic construct
  misc_feature 1..3249: note = Cas9 variant
  source 1..3249: mol_type = other RNA
atgcgcgtactaggactagacgcggggatagcaagcctgggctgggccctgatagagatagaagaaagcaaccggggagaactgagccaagggaccatcatcggggcagggacgtggatgttcgacgcaccagaggagaaaacccaagcaggagcaaaactgaaaagcgaacagaggagaacattcaggggccaaagaagagtggtgagaaggcgacgccagagaatgaatgaggtcaggagaatcctacacagccacggactgctgcctagcagtgatagagacgcactgaaacaacccggactcgacccatggaggatacgagccgaagcactggaccgactccttggacccgtcgagctggcggtggcactcggccatatcgcccgacaccgaggattcaaaagcaactctaaaggggcaaagacaaacgatccagcggacgatacctcgaaaatgaaaagagccgtcaacgagactagggaaaaactagcaagattcgggtcggccgcaaagatgttagtggaggatgagagcttcgtactcagacagaccccaacgaagaacggggcaagcgaaatagtcaggaggttccgaaatagagaaggagactacagcagaagtctactaagagacgacctggcggcagaaatgagggcactattcaccgcgcaggcaagattccaaagtgcaatagcgacagcggacctgcaaacagcatttacgaaggccgccttcttccagcgaccgttacaagacagcgaaaagctagtcgggccctgcccattcgaggtggacgaaaagcgagccccaaaaagaggttacagctttgaactgttccggttcctaagccgactaaatcacgtaacactaagggacggcaaacaagaacgaacactcacaagagacgaactagcactagcggcggcagacttcggggcagccgcgaaagtgagcttcacagcactacgcaagaaactgaaactgccggaaaccacagtattcgtaggggtgaaggcggacgaagaatcaaaactagacgtagtagcaaggagcgggaaggcggcagaaggaacggcgcgactcaggtccgtgatcgtcgatgcactcggggaactagcctggggagcactactgtgctcacccgaaaaactagataagatcgccgaagttatcagctttagaagcgatataggccgaataagcgaagggctggcgcaggcaggatgcaacgcgccattagtggacgcacttacggcagccgcgtccgatggccgattcgatccgttcacaggagcaggacacataagctcaaaggcggcccgcaacatactgtccggactgcgacaggggatgacatacgataaagcctgctgtgcggcggactacgaccacacggcgtcacgggaacgaggagcatttgacgtcggtgggcacggaagagaggcactaaaacgtatattacaagaggaacggatcagccgggaactggtaggcagcccaacagcaagaaaagcgctaatagaaagtataaaacaagtaaaagccatagtggaaagatatggagtgccagacagaatccacgtcgaactggcccgagacgtgggaaaaagcatagaagaaagagaagaaataacaaggggaattgaaaaacgaaatcgccaaaaagacaaactgcgaggcctcttcgaaaaagaagtagggcgcccgccacaagacggagcgagaggtaaagaggagctactacggttcgaactatggagcgaacaaatgggacggtgcctgtacacggacgactacattagtccgagccagctggtcgcgacagacgacgccgtccaggtcgaccacatattgccctggagcagattcgcagacgattcgtacgccaacaaaacgctctgtatggcgaaggcaaaccaagataagaaagggaggacgccctacgaatggttcaaagcagagaaaacagacacagagtgggacgcgttcatcgtacgcgtagaagcgctcgcagacatgaaagggttcaagaaacggaactataaactgcgaaacgcagaagaggctgcggcgaaattcagaaacagaaacctgaacgacacgaggtgggcatgcagactcctagccgaggcactaaaacaactctacccgaaaggagagaaagataaggacgggaaggagagaagacgggtctttagcaggccaggagcgctgaccgaccgcctgcgcagggcttgggggctgcaatggatgaagaaaagcacaaaaggagacaggataccagacgacagacatcatgcactggacgcgatagtgatcgcggcaacaaccgaatcattgctccaaagagcaactcgagaagtacaggaaatcgaagataaaggcttacactacgatctagtcaaaaacgtgacaccaccctggcccgggtttcgggaacaggccgtcgaggcagtagagaaagtgttcgtagcaagggcagagcggcgccgagcaagaggcaaagcgcacgacgcgacgatacgtcacatagcagtaagggaaggagagcagagagtatacgaaagacggaaagtcgctgaactaaagctggccgacctggaccgagtgaaagacgcggagcgaaatgccaggctcatagagaagttaaggaactggatcgaggcgggatctccaaaggacgacccgccactaagcccaaaaggggacccaatattcaaagtgcgactggtaacaaaatcaaaagtaaacatcgcactggacacaggaaacccaaaaagaccaggcacggtagaccgcggcgaaatggcaagagtggacgtgtttcggaaggccagcaagaaagggaaatacgagtactacctggtaccaatatacccacatgatatagcgacgatgaaaacgccaccaatccgggccgtccaagcatacaaaccggaagacgaatggccggagatggactcaagttacgagttctgttggagcctggtgccgatgacgtacttacaggtgatcagcagcaaaggggagatctttgaagggtattacagaggaatgaacagatcggtaggggccatacagttaagcgcacactcaaacagttcggacgtagtacaaggaatcggggcacggaccctgaccgagttcaaaaagtttaatgtggaccgctttggacgaaagcacgaagtggaacgagaactacgtacctggagaggggagacatggagggggaaagcgtatatctga

SEQ ID NO: 7360 - RNA, 3255 nt, synthetic construct
  misc_feature 1..3255: note = Cas9 variant
  source 1..3255: mol_type = other RNA
atgaaaaacaccctctacggcataggactcgacataggcgtcgccagcgtaggatgggctgtcgtcggcctaaacggcacaggggaaccagtcggcctccaccgccttggagtccggatcttcgacaaagcggaacaaccaaagacgggcgaaagcctcgccgccccaagacgcatggcacgcggaatgcgaagacgtctccgacggaaggcactaagacgcgcagacgtctatgcactgctcgagcgatctggcctcagcacacgcgaagcgctcgcacacatgttcgaagccggcgggctcgaggacatctacgcactcagaacgagagcactagatgaaccggtaggcaaggcggagttctccagaatactcctccacctggcccaacggcgaggatttaaaagcaaccgtcgaacagcctctgatggagaagacggacgcctcctcgcagcagtaaacgaaaaccgaagacgaatggcacaaggaggctggcgaactgtcggagaaatgctgtatcgccacgaagcattcgcattacacaagcgaaacaaagcggacgaatatctcagcactgtcgggcgagacatggtagcggaagaagcgagcctactattccaaagacagagagagttaggctgcgcatgggccaccccggaactacaggcagaatacctaagtatcctactaagacaacgcagcttcgacgaaggacccggagggaacagcccctatggaggcaaccaggtagagaaaatggtaggacgttgcacattcgaacccgacgagccccgagcagcaaaggccgcatactccttcgaatacttcagtctgctccagaaaataaaccacataagactcgtcgagaacggcgaaacacgacccctcacgcaacaacaacgacaacagctcctcagcctagcacacaaaaccccggacgtctcgttagctcggataagaaaagagctcgcccttccagaaacagtccaattcaacggcgtgagatgccgagccaacgaaaccctcgaagaatcagagaagaaagaaaaattcgcatgtctccctgcgtaccacaagatgcgaaaagcactagacggagtcgtaaagggcaggatctccagcctttccatctcccaaagagacgcagctgctaccgcactatcgctgtacaaaaatgaagacacactgagagccaaactcacagaagccggtttccaagcccccgaaatcgacgccctcgcaggactaactggcttctcaaaatttggacatctatcactaaaagcctgtagaaaactcatcccccatctcgagcaaggactcacctacgaccaggcatgcagcgccgccgggtacgacttcaaaggccacggcgcaggagagcgtgccttcacactacccgcagctgctccggaaatggaacaaataacaagccccgttgtaaggcgagcggtcgcacaaacaataaaagtagtcaacggcatcatcagagaaatggacgcctcacccgcatgggtcagaatagaactcgcccgagagctgagcaagaccttcggcgagcggcaagaaatggaccggtcaatgcgcgaaaatgcagcccaaaacgaacgcctcatgcaggaactacgcgacaccttccacctactgagcccaacgggccaggacctcgtcaaatataggctatggaaggaacaagacggcgtctgcgcctactcgctcagacgcctcgacgtcgaacgcctgttcgaacccggatacgtcgacgtagaccacatagtgccctattcactcagcttcgacgaccgacgaagcaacaaagtactcgtactaagcagtgaaaaccgacagaaaggaaacagactacccctacagtatctccaaggcaagcggagagaagacttcatagtgtggaccaactcaagcgtccgcgactaccgcaagcgccaaaaccttctaagagaaaaactctccggcgacgaggcagaaggatttcgacaacgcaatctccaggatacccaacatatggcccgcttcctatacaactatatctcagaccatctagcctttgcacaatcagaagccctcggcaagaaacgcgtattcgcagtctcaggcgcagtaacaagtcacctacgcaaacgctggggcctgagcaaagtccgagccgacggagaccttcaccacgcactcgacgccgcggtaatagcctgcacaaccgacggaatgatcaggagaatatcaggctactacggacacatcgaaggcgaatacttgcaagacgcagatggagctggatcgcagcacgcgaggaccaaagaacggttcccggcaccatggccacggtttcgagacgaattaatcgtgcgactatccgaacaaccaggcgaacatctgctagacataaaccccgagttctactgcgaatacggcacggaacacatccgcccagtcttcgtatcaagaatgccacgcaggaaagttacgggccccggtcacaaagaaaccataaaaggcgccgcagccgccgacgaaggcctgctcacagtgaggaaagccctaaccgagctcaaactagacaaagacggagaaataaaagactactacatgccatcaagcgacacactcctgtacgaagcactaaaggcacaactcagacggttcggcggggacagtaagaaagccttcgccgagcccttttacaaacccaaagcggacgggaccccgggccccctggtaaggaaagtcaagaccacagaaaaggccacactcacggtacccgtccacggaggcgcagcctcaaatgacacgatggtgcgcgtcgacgtcttcctagtgccaggcgacggatactattgggtccccgtgtacaccgcggacaccctcaagccagagctacctaacagagccgtagtccagggaaaaccatacagcgaatggaaggaaatgcgcgaggaagacttcatattcagcctatacccaaacgacttagtatacgtcgaacacaaatcaggactaaaattcaccctccaaaacgccgactccacgctagagaaaacccgcacccagacgagcgccttcgtatacttcgtaggcgggtccatctctacggccagtatcaccatccgaacgcacgacaacgcgtacgggatacccagcttaggagtaaagacattaaaaacattccacaaataccaggtagacgtgctcggcaacgtgttccccgtacacaaagaaacccgtcaaaaattcagatga

SEQ ID NO: 7361 - RNA, 3255 nt, synthetic construct
  misc_feature 1..3255: note = Cas9 variant
  source 1..3255: mol_type = other RNA
atgaaaaataccctctatggtatcggcctcgatataggagtagcctccgtcggctgggcagtagtcggtttaaacggcaccggagaaccagtaggactccatcgactcggcgtacggatcttcgacaaggcagaacaacccaaaaccggcgaatccctagcagcgcccaggagaatggcccgcggcatgagaagacggctccggcgcaaagcattacgccgcgccgatgtatacgccctgctagagagatccgggctatcaacccgagaagcgctcgcccagatgtttgaagcaggcggtcttgaggacatctacgccctcagaactcgcgcattagacgaaccagtcggcaaagccgagttcagcagaatactactccacctcgcacagcggagggggttcaaatcgaacaggagaacagccagtgatggagaagacggacggctactagcagcggtaaacgaaaatcgccggcgtatggcacagggcggctggcgcactgtaggagaaatgctctaccgacacgaagcattcgccttacataagcgcaacaaagcggacgactacctcagcacagtaggcagagacatggtagcggaagaagcaagccttttattccaacgccaacgcgaactaggctgcgcttgggctacgcccgaactacaagccgaatacctctcaatccttctccgacaacggagtttcgacgaagggccgggcggagacagcccctacggagggaaccaagtcgagaaaatggtggggaggtgcacattcgaaccagacgagcccagagccgcaaaagccgcctacagcttcgagtatttctccttactccagaaaataaaccatatccgcctagcagagaacggcgaaacccgccccctcacacaaccccaacgccagcaactcttatcactcgcccacaaaacaccagacatgtcactagcgaggataagaaaagaactggccctccccgagaccgtacaattcaacggtgtacgatgtagagccaacgagacattagaagaaagcgagaaaaaggaaaaattcgcgtgcctcccggcctaccacaaaatgcgcaaagcactaggcggtgtagtaaaaggaagaatatccagcctgtccatctcgcaacgcgacgccgccgcaacagccttgtcactctacaaaaacgaagacacactacgagcaaagctgacggaagcagggttccaggcacctgaaatagacgccctagcaggccttactggattcagcaaatttggccacctatcactcaaagcgtgccgaaaactaataccccatctcgagcagggactaacctacgaccaggcttgcagcgcagccgggtacgatttcaaaggtcacggagccggtgaacgagccttcacactacccgccgccgcacccgaaatggaacagatcacatcacccgtggttagacgggccgttgcccaaaccatcaaagtagtgaacggaatcatacgagaaatggatgctagtcccgcctgggtaagaatcgagttagcgagagagctttccaaaaccttcggggaacgacaggaaatggaccgatccatgagagaaaacgctgccaaaaatgagcgactcatgcaggaactaagagacacattccacctactatcgccgaccggccaagatctagtcaagtacaggctctggaaagaacaagacggcgtgtgcgcatactcactacaacgcctcgacgtcgagcaactcttcgaaccgggctacgtagatgttgaccacatagtcccatactcactcagcttcgacgaccggagaagcaacaaagtattagtattatccagcgagaaccgacagaaaggcaaccggctcccactgcaatacctgcaaggcaagcggcgcgaggacttcatagtctggacaaactcctcagtacacgattaccgaaaacgacaaaacctcctacgggagaagctctcagacgatgaagccgaagggttcagacaacggaacctccaagacacccaacacatggcccgcttcctctacaactacatcagcgaccatctcgcatttgcacaaagcgaagccctgggaaagaaacgcgtattcgcggtctccggcgcagtcacaagccacctccgaaaaagatggggcctctcaaaagtaagagcagatggagacctacaccatgccctagatgcagcagtcgtagcttgcaccaccgacggcatgattcgacgaatatcaggttattacggccacatagagggagaatactttcaagatgccgacggcgcgggctcacagcacgcgcggacaaaagaacgcttccctgcaccctggccccgcttccgcgacgaactgatcgtccggctatccgaacaacccggagaacccctactagatataaaccccgctttctactgcgaatatggaactgaacacatcaggcccgtcttcgtatccaggatgcccaggcgcaaagtcacaggcccaagccacaaggaaaccgtaaagggcgcagcagcagcggacgaaggcctgctcacagttcgcaaagcgctgacagaactcaaactcgacaaggacggcgaaatcaaggattactacatgccaagcagcgacaccctcctctacgaagcattaaaagcacaactgcgacgcttcggtggcgacggcaagaaagcattcgccgagccattctacaaacccaaagccgacggaacccccggccccctcgtcagaaaagtaaaaacaacagaaaaggccacgctaacagtccccgtccatggcggcgccgccagtaacgacacaatggtgcgaatagacgtattcttcatgcccggagatggatattactgggtccccctctacgtcgcagacacactcaaacccgaactacccaatcgcgccgtggtagcccacaaaccctacagtgaatggcaggagatgagagaagaggacttcgtattctcactctacccaaatgacttggtgtacgtagagcacaaaagcgaactaaagttcaccgttcaaaatgccgactcgaccttggagaaaacccgcacacaagcctcagcattcgtctacttcgtcagcggcggtatctcaggcggaaccatcacagtaagaacccacgacaacagctacggtatccccagcctcggcctcaaaaccctaaagtcactatgcaaataccaagtagacgtgctcggaaacgtattcccagtgcacaaagaaacgagacaaaaattccgctga

SEQ ID NO: 7362 - RNA, 3255 nt, synthetic construct
  misc_feature 1..3255: note = Cas9 variant
  source 1..3255: mol_type = other RNA
atgaaaaacactctttacggaatcggcctggacataggcgtagcctccgtcggctgggcagtagtcggcctcaacgggaccggggaacccgtaggacttcaccgcctaggcgtacgaatcttcgacaaggccgaacaacccaagaccggagaatccttggcagccccacggcgaatggcaagaggcatgcgacgtcgactgcgccggaaagccctcagacgagccgacgtatatgcactcctagaacggagcggactaagcacccgagaagaactagcccaaatgttcgaagccggaggactcgaagatatctacgcactccgcactcgcgccctagacgaacccgtcggcaaggccgagttctcccgcatcctcctacacctggcacaacgcagagggttcaaaagcaaccgccgcacggcctctgacggtgaagacggcagactcctcgctgcagtcaacgaaaatcgtcgccgtatggcacaaggcggctggcgaacagtcggggaaatgctctaccggcacgaagccttcgctctgcacaaacgcaacaaggcagacgactatctatcaaccgtcggccgagacatggtagctgaagaggccagcatattatttgaacggcaacgtgccatgggctgcagctgggcagcaccagaactgcaagccgaatacctatcaatactcttacgacaacgtagcttcgatgaaggacccggcggcaacagcccctacggaggcaaccaagttgagaaaatggttggccgatgcacgttcgaacccgacgagccccgagcagctaaagcagcctacagcttcgaatacttttcgctcctgcaaaaactcaaccacatccgactggcagagaacggcgaaacacgacctctcacccaaccacaaagacaacaactcctttccctggcccacaaaacccccgatatcagcctcgcccgaatcagaaaagaacttgctctccccgagacagtgcaattcaacggcgtaagatgcagagccaacgagaccctggaggaaagtgagaaaaaggaaaaattcgcctgcctcccagcctaccacaaaatgcggaaggccctagatggagtagtaaaaggtcgaatatcctccctgtccatctcccaaagagacgccgcagccacggctcttagtctttacaagaacgaagacacgcttcgagccaaactcacagaagctggttttcaagccccggaaatcgacgccctcgccggacttacaggcttcagcaagttcggccatctctccctcaaggcatgtcgcaaactcatcccacacctcgaacaggggttaacctatgaccaggcatgcacagcagcagggtacgacttcaaaggtcatggcgccggcgagcgagcattcacgctcccagcagccgcccccgaaatggagcaaatcacctcacctgtcgtccgccgcgcggttgcacagactatcaaagtagtaaacggaatcatccgcgaaatggatgcctcgcccgcatgggtcagaatcgaactcgcccgcgagctcagcaagacattcggagagcgccaagaaatggaccgatctatgcgcgagaacgcggcacagaacgagcgcctcatgcaagaactccgagacaccttccacctactctcacccacaggacaagacctggtaaagtacaggctatggaaagaacaagacggcgtctgcgcgtacagcctccgccgactggacgtagaacgcctctttgaacccggatacgtcgacgtcgaccacatagtcccatactccctctcattcgacgaccgacgcagcaacaaagtcctggtactgtcctcggaaaacagacaaaaaggcaaccgactaccactacaatacctgcaaggtaaacgacgagaggacttcatcgtctggacgaacagctcagtacacgattatcgcaaacgacaaaatctacttagagaaaagctctcaggcgacgaagcagaaggattccgccaacgaaacctccaagacacacaacacatggcccgcttcctctataactacatcagcgaccacctagcattcgcgcaatcagaggcgctcggcaaaaagagagtatttgctgtatccggagcagtcacatcacacctaaggaaacgatggggcctcagcaaagtccgcgcagatggcgacctccaccacgcactcgacgccgccgtcgtcgcctgcacaacagacggcatgatacgccgcatttcaggctactacggtcacatcgaaggggagtacctacaagacgctgacggggcaggatcccagcacgcaagaacaaaggagaggtttcccgccccctggcccagattccgagacgaactaatcgtccgactctccgaacaacccgcggaaccactattagacataaacccagagttctactgcgagtacggaacagaacacattcgaccagtcttcgtatccagaatgccccgacgcaaagtcacaggccccggacacaaagaaacaataaaaggcgcggcggccgccgacgaaggtctcctcacggtacggaaagccctaacggaactaaaactcgataaagacggagaaataaaagactactacatgccatcctcagacacactactttacgaagccctaaaagcacaactaaggcgattcggaggggacggcaaaaaggcctttgccgaacccttctacaaaccgaaagccgacggcacacccggcccgctagttcgcaaggtcaagaccaccgaaaaagcgacactaaccgtcccagtccacggcggagccgcatcaaacgacaccatggtgcgagtcgacgtttttctagtcccaggagacggctactactgggtccccgtatacaccgcagatacccttaagccggaactcccgaacagggctgtcgtccaagggaaaccctattcagaatggaaagaaatgcgagaagaagacttcatattcagcctataccccaacgatctagtatacgtcgaacacaaatctgggcttaaattcacgttgcagaatgcagactcaaccctagagaaaaccaggactcaaacatcagcattcgcctacttcgtctctggctcgataagcaccgcctcaatcacaatccgaacccacgacaacgcgtacggcatcccctcactcggagtcaagacactcaaaacattccataaatatcaagtagacgtcctaggaaacgtcttcccagtacacaaagaaacacgacagaaatttagatga

SEQ ID NO: 7363 - RNA, 3255 nt, synthetic construct
  misc_feature 1..3255: note = Cas9 variant
  source 1..3255: mol_type = other RNA
atgagacttggcctggatatcgggacgaacagcatcggatggtggttatatggaacggaaggagggcgaataacagaagtcgtcgacgggggagtaagaatattctcagacgggcgcgatccgcagagcaaggccagcctagccgtcgaccgcagagcagcgaggagccaacgacgaaggagggatagatacctcagacgcaaagcagcactcatgaagagaatggcgcaagtaggattgatgccggctgacccagccgaggcaaaagtgctagaggtactaaacccgtacgaactaagggcttcaggcttagacggacccctaccactaacccacttcgggcgcgccctcttccacctgaaccaacgcagagggtttaaaagcaaccggaaaacagatcgtggcgataacgaatcaggtaaaataaaagacgctacagccagactagaccaggcgatgatggcgaagggagcgagaacgtacggcgagttcctccacatgaggagagcagccgcgctggacccaaaaagcgtaccatcagtcagaacaagactgacggtcgcaaggagggacgacgccgaaaaagaagaagcaggatacgacttctaccctgacaggaaacacctaagcgaagagttcgataagctatgggcagcccaagccaggcacgcgccagacgtattaacagaagacctacgggatgaaatcgcgacaataatattccaccaacgacccctaaaaacgccagaagtagggctctgcctatttaccgggcaacacggcgtaccagaacgcgacaaaagaatcccaagtgcgcaccccctcaaccaacgacgaatcctcatggaaacagtcaacaacctaaaggtggcagcgcagggcgaaccaagccgaccgctaaccagagaagaacgagatcagattgtccatgccctggacaacaagaaacacacgaaatcactatccggcatgacgatgaaactgaaagcactgggaaaagtaataaaactacggcctgaacaggggttcacactcgaaactgcaaacagagacgccatcgcatgcgacccagtgagagcgagcctgtctcacccagaccgcttcggagcacgatggagcaccctcgaaagcgcagggcagtgggacgtagtacaacgaatcagggccgtgcaatcagacgcggaacacgcagaccttgtgggctggctgatggacgtacacgggttagaccgagaccatgcagaagaaactgcaaacgctccactgccagagggatatggcaggctaggactcacggccacgacgcgcatactagcagccctggaggcagatgttctaaactactcggccgctgtagctgcatgcgggtggcaccacagcgacgggcgaacaggggaagtcctggagtcactcccttactatggagagattctcgaaagacacgtgataccgggcaccggagaccccaacgacgacgacgtcaaaaggtacggaagaataactaacccgacagtgcacatcggactgaatcagctaaggaggctcgtcaacaggatcatcaccgtgtacggacgcccggacgagatagtagtagagctagcgcgcgatctcaaactctcagaagaccaaaagaaagacgtacaacgcgacatcaagaaaaacacagaggccgccattaggcgagggaagaaactagaagagatgggtgtacccaacaccggagcgaaccggatggtactccgcctgtgggaggacctgggcgatgatgtgatgacacgaaactgcccctacactggcaaacgaatatcagcaggcatgctgttcgacggcagctgcgacgtagaccacatcctaccatacagcagaacactcgacgacagcttcgccaacagaacactgtgcctcaaagaagcgaatagacagaaaacggacaaaacaccttgggaagcctggggagaaacagagcaatgggaggcgatagctgctaacctgaaaaacctcccagcgaataaagcatggaggttcgcaccagacgcaatggaaaggttcgaaggggaaaaagatttctcagcacgagccctagcagacacccaatacctatcgcggattgcaagggcgtacctggacgcactctacgacggtgacgacggcaaatcccacgtctgggtggtaccaggccgactgaccgaaatgctgcgaaggcactggggactaaacggagtcgcggcactgacagacagcgacaaacagacagtgaaagcgaaaaacaggacagaccatagacatcacgcaatcgacgcagccgtggtagcagcaaccgatagagggctcataaaaagaatagcggacatggcgaagcgagacgagtttaacggagccgaggaagtcgcacgaagcataccaccgccctgggaaggattcagagacgacgtgtcagcacaagtaacacgaataatagtaagccaccgtgcagaccacggcagaatagaccccgccgcacgaaaatccggacgagactcaacctcaggccaactccacaacgatacagcatatggcataggcagagacggaaccgtcgtgagcagaaaacccctcgcatcccttagcccaaacgacatagtggtcaccaaacgtggagccaacataagagacgtagacctacagaaacacctagcgcgtgttacccacgggctagacggaaaggctttcgaagccgcactcctggcattcgccgccagcccaatcctaccagacaacacggacaacccctacttcggactccggcgcgtgagactcgaagaaacgctacaagaaagcgcgagagtagaggtagcagaccaagagggaaggccctacaaagcatacaaaggcgacagcaaccactgctacgaaatatggtgcctacccgacggaaagattaaaccccaagtggtaacaacatacgaagcacaccagtcaggcgcagagaaaaagccacacccagcagcaaaaagactcatgcgaatattcaaacgggacatggtcatgctcgaacgcgacggggaaacgatcatcggatacgtacagaaaatgaaacaaaacggaagcatcttcgtcgccccacacacagaagcaaacgcagacgcccgagacagagacccgaaggacgacttcaaactcatccagctcggcgccggtagcttagtgaaagcaaaagccagaagagtgattgtagacgaaatgggccgactccgcgacccaggcccgccactctga

SEQ ID NO: 7364 - RNA, 3258 nt, synthetic construct
  misc_feature 1..3258: note = Cas9 variant
  source 1..3258: mol_type = other RNA
atggacaagggcaccaactcgatcggatgggccgcgctaaggctagacgaacaaggagaacccgtagggataattgaggctggcgtgcgcatatacgccgacgggagagaaccaaaatcagggacttcgctcgccgagggccgacgaatagcacgaggaatgtcgcgccgcagagatcgttataaacgacgccgacgaacggtactaaacaccctgacggagttcggactcatgccggccaccaaggccgcaagaaaggccctcgtggccgaaacaaacgaccgaaggttcggcgaagtagcctccaacgtatatgcactccgagcaagagccctagatgaaaagctcccactatatcaactagggagagcactgttccacctaaaccaacgccgaggtttcaaatcgaaccgaaagacggataagagagacaacgaccagggcaaaatcgcctcagcaatctcgagactaggacgaaaacttgacgaagcaggagcgcgcaccctcggtgagttcctccacaagcaacatgcagccgggaaatgggtaagggtgcggcccagtcgagtaccgggcgaagacgacaaggaagaagacggatacggattctacccagaaaggtcattcctcgaaagagagttcgcggccatatgggaagcgcaggccgccttctaccccgaactgctaacagaggaaagaagggaccatctgcactgggtaatgttcttccagagaccactaaaaagaccaaccgtcggcaaatgcagcttccaccccgacgaagaccgattacccaaggcacaccccctattccaagaatttagactaattaaagagctcaatgagctagaagtggtgcacagaggagacagacgcgaaaaacttaccccagatcagagagaccgactcttcaatcaactcagaacacaaagatcctcggcattcaccgcactcaggaaaacaatcaaagccccaaccggcacgaggttcaacaaagaatcggacgcccgcgacaagctgaaaggcgacgaagttgccgcggaaatgagccacaaagaccgatttggccaagcctggataggaatgccgctagcagaaagatgggccgtagtagccatgcttctcgacacggaagaccccctagaagtgaaggcgtggctcgaagaacggtacggcttcgctgccgaccgaatcgacgccatagccgcagccaaactaccaacgggatacggacgcctaggcgaaacagcactccgagacatgctcgacgaactacgaaacggcaccgtcaaagatgacgcgggacgggacgtcgtcctcacggaacgacaggccatggacaacatatggggagacaaccccgcactccaacgcgcagttacagacgcaagagagttacccccttaccaagaagttctaggccgccggatacctcccggcaccggcaaacccgcagacccatatgacgtccagaaggggcgactcacaaatccaacagtacacatcggtctaaaccagctgaaaaggatagttaacgtactaatgagacgccacgggcgcccagaacagatagcactcgaactcgcacgcgacctaaaacttaatgaagaacaaaaggcagagaaaaatcgcgaaatagcaagaaacaccaaagccgccgaagccagagggaagaaactcgaagaactaggccacgcgaacaacgggtacaacagggtgctcctcaagttatgggaagacctcaacctgaaacaaccggaaaacagagaatgcatatactgcggtaaggcgataggcataggaacacttctgtctaaccaagtcgacatcgaccacatcctaccatggtcaaagaccctagatgattcacaggccaacagaatcgtctgccatgtagaatgcaacagacagaagggcaaccacgcgccagcagaagtcccccaatggcacgaccgatacgatgacatactagcacgcgcagaacgcctacccagaaacaaagcctggagattcggacgggaagcgatgaagaaattcaaagacgacgaatccttcctagccagacagctaactgacacccaatatctcagccggctagcacacgaatacctgggcgccctataccccgacgaggaaccggacgaatggggcggaccggcaagacgaaatcacgtaagagtgataccaggaagaatgacagaaatgctacgccgccaatggggcctcaacgccataatatcggaccacaaccagaaaaacagaaacgatcaccgccaccacgcaatagacgctatcgtagtgggtgtaacaacaaggagactcctccaaagaatcgcgaccgtcgcaggcggcagggaggccctagccctcgaagaaaccataggaaaaatcgaaccaccctggcccggattctacgacgacgtgaaagccgcaatagaccgtatcgtagtgtcccataaacccgaccacggatcactacccaaaccaggaaagcccggtagaacggctggccaactccacaacgacacagcatacggtttcacaggagaagcgagaaacggcgtgccaatcatggtccacagggtgccgttcgcgtcgctaaccgaaaaggacatcccgagcatacgagacagacagctagccgatgcgttgtacgctgcaataagcggaattagcggaaaagcggaactcgcagccgcactagcccgatttagtgagtccggaccgtacaaaggcatacgccacgttagggtcgtagaacccgtatcggtgatagcgataaaagaccaagcaggaaaggcctacaaaggatacaagggagacgcaaactaccgatacgacgtatgggagctgccaaacgggaaatggacacacgaagtagtatcaatgttcaacgcacaccgacccgactggcaaagcgaaataagatcgaagaatcccgccgcaagaaaagtactatccctgcatcaaaacgatatggtagcctacgagcacccacaagacggatataccattggacgcgtcgttaaattcagcgccggaggccaaatggcactagccggaaatcgcgaaggaggagccctcaagtccagagacgcagacccagaagaccgattccgatacttctacaaatcaggaggagcgatgcgcgacgtccaactcagacaagtgcgggtggacgaaacagggagagtgttcgatcccggaccacaggatagagagtcacggaatgcccgaaagcaaaacgacgcagggtga

SEQ ID NO: 7365 - RNA, 3264 nt, synthetic construct
  misc_feature 1..3264: note = Cas9 variant
  source 1..3264: mol_type = other RNA
atgcgctacaaaatcggcctcgacatcgggataacatccgtggggtgggccgtcatgaaccttgacataccccgcatcgaagatctcggcgtccgcatcttcgacagagcagaaaacccccagacaggcgaatcgctcgccctccctagacgattagcacggtccgcccgccgccgactacgccgacgaaaacatcgtctcgaacgcatacgccgcctcgtaatacgagaaggtatactgacaaaagaagaactggacaaactgttcgaagaaaagcacgaaatcgacgtctggcaacttcgagtagaagcattagaccgcaaactaaataacgacgaattagcccgcgtcctcctccacctcgcaaaaagacgaggcttcaaatccaaccgtaaatcagaacgatcaaataaagagaacagtaccatgctcaaacacatagaagaaaaccgcgccatcctatcgtcataccggacagtaggcgaaatgatcgtcaaggacccaaaattcgcactgcacaaaagaaacaagggcgaaaactacacaaacacgatcgctcgcgatgacctagaacgcgaaatcagactcatattcagtaaacaacgcgagttcggaaacatgagctgcacagaggagttcgaaaatgaatacataaccatctgggcaagccaacgccccgtggcgagcaaagatgacatcgagaagaaagtcggcttctgcacattcgagccaaaagaaaaacgcgcgcccaaagccacatacacattccagtctttcatagcatgggaacacatcaacaaattacgcctgatatcaccgtcgggggcacgtggcttaactgacgaggaacgacgcctgctgtatgaacaggctttccagaaaaacaaaatcacctaccacgacatccgcacgctactacatctgccagacgacacgtacttcaaaggaatcgtctacgacagaggcgaatcccgcaaacaaaatgaaaacatacgctttctcgaactagacgcgtaccaccaaatcaggaaggcagttgacaaagtctacggcaagggtaaatccagtagcttcctacccatcgacttcgacacatttggatacgccctaaccctcttcaaagacgacgccgacatacactcctacctacgaaacgagtacgaacaaaacggcaaacgaatgccgaacctcgccaacaaagtatacgacaacgaacttatcgaggaactactcaacctctccttcactaaattcgggcacctttcactcaaagcactacgatcaatcctgccttacatggaacagggagaagtctactcctccgcctgcgagagagcaggatacacattcaccggtccgaagaagaaacagaaaaccatgctacttccaaacatcccacccatagccaacccggtagtgatgcgcgcactaacgcaagcgcgcaaagtcgtcaacgcgatcatcaagaaatatggctcccccgtctccatacacatagagctcgcccgagacctgagccaaacgttcgacgaacgccgcaaaaccaaaaaggaacaagacgaaaatcggaagaaaaacgagacagcgatcagacaactcatggaatacggtctaacactcaatccaacaggacacgatattgtcaaattcaaactctggtcagagcagaacggccgctgcgcctacagtctgcaaccaatcgaaatcgagagactgctggaaccaggctacgtcgaagtcgaccacgtcataccctacagccgctccctagacgattcatacaccaacaaagtactcgtacttacacgtgaaaatcgcgagaagggcaaccgtatccccgcggagtacctcggggtaggcacggagagatggcaacaattcgagaccttcgtacttaccaacaaacaattctccaaaaagaaaagggatagactacttcggctacactatgatgaaaacgaagaaacagagttcaaaaaccggaacctcaacgacacgcggtacatctcccgcttcttcgcaaatttcatccgagaacacctcaaattcgcggaaagtgacgacaaacaaaaagtgtacaccgtcaacggaagagtaacagctcatctcagaagccgctgggagttcaacaaaaaccgagaagaatcagacctgcaccacgccgtcgacgctgtcatagtcgcatgcacgaccccgtccgacatcgccaaagtaacagccttctaccaacgccgagagcaaaacaaagaactcgcaaagaaaaaggaaccacacttcccccaaccgtggcctcacttcgccgacgaattacgagcaagactctccaaacaccccaaagagagcatcaaagccctgaaccttggtaattatgacgaccagaagctcgagagcctacaacccgtgttcgtaagccgaatgccaaaacgctcagtaacgggcgcagcccaccaagaaacactccgacggtacgtaggcatagacgaaaggtccggcaagatacaaaccgtcgtcaaaacaaaactctccgagataaaactggacgccagcggccacttccccatgtacggaaaagaatccgacccccgaacctacgaagcaatacgccagcgcttactcgagcacaacaacgaccccaagaaagccttccaagaaccactttacaaaccaaagaaaaacggcgaacccggcccagttatccgaaccgtcaaaatcatagacaccaaaaaccaagtcatccccctgaacgatggcaaaacagtggcctataactctaacatagtcagagtcgacgtatttgaaaaagacggaaaatattactgcgtccccgtctacaccatggacataatgaaaggcatcctaccaaacaaggcaatagaaccaaacaaaccatattcggaatggaaagagatgaccgaagactacaccttccgcttctcactatatccgaacgacctgatacgcatagagctgccaagagagaaaaccgtcaaaacagccgcaggagaagaaataaacgttaaagacgtctttgtttactacaaaacaatcgattccgccaacggagggctcgaactaatcagccatgaccacagattcagcctccgcggcgtaggatccagaacactaaagcgattcgaaaagtaccaagtcgacgtactcggcaacatctataaggtacgcggagaaaagcgcgtaggtctagcctcgagcgcacactccaaaccagggaagaccatacggcccttacaaagcactcgagattga

SEQ ID NO: 7366 - RNA, 3264 nt, synthetic construct
  misc_feature 1..3264: note = Cas9 variant
  source 1..3264: mol_type = other RNA
atgctgcgtatgaaatacgccatcggactcgacattggcatcgcctcggtaggctacgctgtcctcgcgctcgatcacgaagaaaacccgtggggcatcatcaggctcggatcgcggatcttcgacgtcgcagaaaatccaaaggacggcgccagcctagcattaccacggcgagaagcgcgctcagtccgacggcgcctcagacgtcaccaccaccgcctggaacgcattaaaaacctgctaataaacaccgagttcataacaaaggacgaactgctccacctctacgacggaaaccttagcgacgtttacgaactacgcgtaaaagctctcgactactcagtcaccaatgcggaactcactaggatactacttcatttagctcaacgcagaggcttcaaaagtaaccgtaagagcgacgccaacgacaaggaagccgggcaactcctcgaagcagtgtccgccaacgccaaacgtatgcaagagaatcattaccgcaccgtaggggaaatgttctacaaagacgacctattcagcaagtacaaacgcaacaaagggggcacctatctaacaaccgtacaccgagacatgattgccgcggaagcccgcaccattctagaaaaacagtttgccctcggcaacaacatatgcacccaagacttcatcgacaaatacctctccatcctactatcccaacgccagttcgacgaaggcccgggagagccttccccctacgccggaaatcaaatcgcaaacatgataggaaagtgcacattcgagcctaacgaatacagggcggcaaaggcctcgtactctttcgaacgattcaacctgctacaaaaggtcaaccacctccgtctactccttgagggcaagtccatagcacttgacaacgaacaaagaaagaaaatcatagccctcgcacatgacaaagcagatctccgctacagccacatccgcaaagcgctaggcctcgacgaaaaagtcctcttcaatacaatcacttacaacgacgacgtatccgttatagagaaaaagacaaagttcaacttcctccaagcataccaccagatcaagaaagtcctggccgaagatatgcaaaaactaactacggagcagctcgataacatcggccaaatactctcaacctataaatcggataacaaacgaaccgaagaactgagcgccctaggactagagaagaaaataatagacgcactccttggcataaacgggctctccaagttcgcccacctgtccctaaaagcactccgaaaaatcaacccctacttagaagaaggcaaaatatacaatgaagcgtgcacggccgcaggctacgacttcaaggcacacgccaacacacagaaaacagaactcctgccagcctacaaggaagaaatggacgacatcacctcacccgtagccaggcgcgccatcgcccaaagcataaaggtaatcaacgccatcattcgcgaacaaaagggatccccactctacattaacatagagctagcccgggaaatggccaaaggcttcgacgaacgaacccaaatagacaaagccaacaaagagaaccaagcaaagaacgaacgtataatggaacgaatccgcactgagttccacaaagctaaccccacaggaatggacctaataaaactgaaattatgggaagaacaagacggacgtagcccctattctcaaaaagcaatatccatcaaccgtctgttcgaacccggctatgtcgacatcgaccacatagtcccctactctatcagcttcgacgattcgttcaaaaacaaagtacttgtattcagcgacgaaaatcgagacaaaggcaacaggctccccatcgcatacctccaatccaaattcggagctaaagcagccgaaaacttcatgatatgggtccaatccaacatcaaagattacaagaaaagacaaaaactactaaaaagggaaatcacagaagaagacataaacaaatttaaagagcgtaacctccaagacactaaaaccatctcccgcttcctatataactacataaacgactatctactgtttgcaccctcggacacgggcaaaaagaaacgcgtcaccgccgtcaacggaacaattaccgcctacctaagaaaacgctggggtataaacaaaatacgggcaaacggagacaaacaccacgcagtggatgccgtagtgatcgcctgcacaaccgacaagatgataaaagacctttcctccttcagtcgatatcacgagctcgaatacacccacacggacaccgaatccttccttgttaatagcctaaccggggaaatcttaaagcggttcccgtatccctgggaagacttccgacccgaacttatggcacgtctcagcgacaaccccgcagacgccctacgcaaactcaacctcatcttctaccacggaatcgacctctcaacaatcaagcccatcttcgtctccagaatgccacggcacaaagtcacgggagctgcccacaaagccacgatcaaatccgcaagatgtcttgacaacggcatcgtcatctgcaaaacatccctccaaaacctcaagctagacaaagaaggagaaatagccaactactacgcacccgagagcgacaccatcctatacaacgccctaaaggaacgcttacggtcctacgacaacaagccggcaaaagcgttcgccgaacccttctacaaaccgaaagccgacggaactcccggacccctcgtcaagaaagtaaaggtatatgagaagagtacgttgaacgtagcggtacagcaaaacacagccgtagcggacaatgacagcatggtcagagtagacgtctttcacgtaaaaggcaacggatactacctcgtccccatctatatcgcagacaccctcaaaaaggaactccccaacaaggccatagtcgcttacaagccatacgcagactggccggtgatggacgactctaacttcatcttctcactgtatcccaacgacctcatcaaattcgagcacaaaaattccgttaaattcgccaaagtcaacaaagaatcaacactaaacgacttctactccaccaagagtgagatcgtatacttcaaagggtgcaacatcaataccggggccataaccatcataaatcatgaaaacacttacgtcgtatcctccctcggcgtcaaaacgctcccctcactcgagaaataccaagccgacgtcctcggcaactacaccaaggtaaagaaagaagtacgcaaacccttccgatga

SEQ ID NO: 7367 - RNA, 3264 nt, synthetic construct
  misc_feature 1..3264: note = Cas9 variant
  source 1..3264: mol_type = other RNA
atgcgctacaaaatcggactcgacataggcataaccagtgtaggctgggccgtcatcaacctggacattccacgaatagaagacctaggcgtacgaatattcgaccgcgcagaaaacccacaaactggtgaaagcctagcgctaccccggcgtttggcccgctcagcccgccgacgccttcggcgccgcaaacaccgccttgaacgaatacgtcgcttaataatccgcgaaggaatcctaacaaaggaggaactagacaaactcttcgaagagaaacacgaaatcgacgtctggcaactacgagtagaggccctcgacaggaaactaaacaacgacgaactcgcaagagtgcttctgcacctcgcaaagcgccgaggcttcaaatcaaaccgaaaatccgaacgcagcaacaaggaaaactccacaatgctaaaacatatagaagaaaacagggctatcctatcttcctaccgaaccgtgggcgaaatgatcgtcaaagacccgaaattcgccctccacaagcgtaacaagggagagaactacaccaacacaatagcgcgcgacgacctagaacgcgagatacggctaatcttcagcaaacaacgagagttcggcaacatgagctgcacagaagaatttgagaatgaatacatcgcgatctgggcgtcacagcgccccgtcgctagcaaagacgacatagagaagaaagtcggcttctgcacattcgaaccgaaggagaagagagcaccgaaagccacctacaccttccagagcttcatcgcctgggaacacataaataaactccgactcatcagcccatccggaactcgcggacttactgatgaagaacgtcgtctcctctacgagcaagcgttccagaaaaacaaaataacttaccatgacatacgcaccctcctccacctcccagacgatacctacttcaaagggatagtgtacgaccgcggagaatccaggaaacagaacgaaaacatacgtttccttgaacttgacgcctaccaccagataagaaaagcagtcgacaaagtatatggaaaaggaaaaagcagctcattcctccctatcgacttcgacaccttcggctacgcactcacactcttcaaagacgacgcggacatacgatcctacctcagaaatgaatacgaacaaaacggcaaacgtatgcccaacctcgccaacaaagtctacgacaacgagctcatcgaagaactcctcaacctttccttcacaaaattcggccacctaagcctcaaagcccttaggtccatcctcccatacatggaacaaggtgaggtctacagctctgcatgcgaaagagcaggatacaccttcacaggacccaaaaagaagcagaaaactatgctactccccaacatacccccgatcgcaaatccggtcgtcatgagagcactgacccaagcgcgtaaagtggtaaacgcaatcatcaagaaatacggcagccccgtaagcatccacatcgagttagcgcgggacttaagccaaacgtttgacgaacgaagaaaaaccaagaaagaacaagacgagaaccgaaagaaaaacgaaacggcaatacgacagctcatggaatacggactgaccctgaaccccaccggtcacgacatagtaaaattcaaactctggtcagaacaaaacggccgatgcgcatactccctccaaccaattgaaatcgaacgactcctagaacccggatacaccgaagtcgaccacgtcataccgtacagccggagtcttgacgactcatacaccaataaagtacttgtactaactaaagaaaaccgggagaaaggaaatcgcatccccgccgaatacctgggcgtgggcaccgaacggtggcaacaattcgaaacctttgtactcaccaacaaacaattctcaaagaagaaaagagaccgcctgctccgcctccactacgacgagaacgaagaaacagagtttaaaaacaggaacctaaacgatacaagatacatctcccggttcttcgcgaatttcatacgtgagcacctaaaattcgcagaatcagatgataaacagaaagtatacacagtaaacggccgcgtaaccgcccacctccgctcaaggtgggagttcaacaaaaaccgggaagaaagcgacctgcaccacgcagtcgacgccgttatcgtagcctgcacaacaccaagcgacatagccaaagtgaccgccttctaccagcgccgagaacaaaacaaagaactggccaagaaaaccgaaccacacttcccccagccctggccccactttgccgacgaactccgcgcgcgccttagcaaacacccgaaagaaagtataaaggcgctgaacctaggcaactatgacgaccaaaaactcgaatcactacaacccgtattcgtaagtcgcatgcccaagcgatccgtaaccggggcagcacaccaagaaacactacggcgctacgtaggcatcgacgaacgcagcggcaaaatccaaacagtcgttaaaacaaaattgtcagagatcaaactagacgcgagcggccactttcctatgtacggtaaagaatccgatccccgcacatacgaggccatccgacaaagactcttagaacacaacaacgaccctaaaaaggcctttcaagaacccctatacaaaccgaagaaaaacggagagcccggccccgtcatacgaaccgtcaaaataatagacacaaagaaccaagttatacctctcaacgacggcaaaaccgtggcctacaactccaacatcgtacgggtagacgtattcgaaaaagacggaaagtactactgcgtccccgtctacaccatggacatcatgaaaggaatcctcccaaacaaagccatagaacccaacaaaccctactcggagtggaaggaaatgaccgaagactacacctttagattttcgctataccccaacgacctgataaggatagaactaccccgcgaaaagatcatcaagaccgccggtggagaagaaataaaaataaaagacctcttcgcctattataagacgatccactctggaaccgccggactagagctagtctcccacgactgctccttctcactctctggcgtcggctcacgtaccctcaagagattcgaaaaataccaggtagacgtcctaggcaacatatacaaagtccgaggagaaaagcgcgtcggcctcgcatcaagcgcccactcgaagacaggcgaaacaatacgccccctccaaagcacacgggactga

SEQ ID NO: 7368 - RNA, 3264 nt, synthetic construct
  misc_feature 1..3264: note = Cas9 variant
  source 1..3264: mol_type = other RNA
atgcggtacaaaataggcctcgacatcgggataacttcagtcggatgggcagtcatcaacctagaccttccacgcatagaggacctaggcgtccgcatcttcgaccgcgcggagaacccacagaccggcgaaagcctagcgctcccacggcggcttgcgagatcagcacgacgccgactccgacgacgtcgacacagactcgaaagaatccgcagactactcacccgtgaaaacgtccttacacaggaagaattggacaaacttttcgagaaaaagcacgaaatcgacgtctggcaactacgcgtagaggcactagaccggaaacttaacaacgacgagctcgctcgagtcctgttacacctagccaaacgccgcggatttaaaagcaacagaaagtcagaacgatctaacaaagagaacagcacaatgctaaaacacatcgaggaaaaccgcagcatactcaccggctatcgtacagtaggagaaatgatcgttcgagacccgaaattcgtccttcacaaacggaacaaaggagaaaactacaccaacaccatagcccgtgacgacctcgaacgagaaattcaactaatcttcgcgcgacaacgcgagttcggaaacatgatatgtacggaagcattcgaaaacgagtacatcgccatatggtcatcccaacgccccgtggcatccaaggacgacatagagaagaaagtcggcttctgcacctttgagcccaaagaaaaacgagcacccaaggctacgtacacattccaatcattcatcgcatgggaacacataaacaaacttcggctcgtctccccgagcggcactcgcgaactcaccgacgaagaacggcgcctcctctacgaacaagcgttccagaaaaacaagctcacgtaccacgacataagaactctcctgcatctgccagacgacacctatttcaaaggcatagtgtatgactggggagaaccactaaaacagaacgaaaacatccgatttctcgaactcgatgcctaccaccaaatcagaaaaaccgtagacaaagtttatgggcgtggcaagtccagctcattcctacccatagatttcgacaccttcggctacgccctcaccctcttcaaagacgacgcacacatccgctcatacctaagaaacgaatacgaacagaatggtaagcgcatcgcaaacctagcaaacaaggtctacgacaacgaactcatagaggagctactcaacctcagcttcacaaaattcgggcacctaagcctaaaagccctccgtaacatcctaccctatatggaacagggcgaagtgtacagcagcgcctgcgaacgcgcagggtacacctttaccggccccactaagaaacagaaaaccgtcctacttccgacaatcccacccatcgcaaaccccgtcgtcatgcgagccctaacacaagcccgaaaagtagtcaacgcgatcataaagaaatacggctcccctgtgtcaatccacatagaactggctcgcgacctctctcaaactttcgacgaacgcaagaaaacgaagaaagaacaagatgagaaccgcaaacggaacgaaacagcaatacgacaactaatcgaatatggactgacacgaaaccccacaggacacgacatagttaaattcaaactatggagcgaacagaacggccggtgcgcgtactccctccaacccatcgaaataaaacgcctactcgaacccggctacgtagaagtcgaccacgtaataccctactcccgctccctagacgacagctacacaaacaaagtcctagtactaaccaaagaaaaccgggaaaaaggcaaccgaatccccgcggaatacctcggcgtcggaacagaacgctggcagcaattcgagacgttcgtcctcacaaacaaacaattcagcaaaaagaaacgggaccgattactacgcctacactacgacgagaacgaagaagccgaatggaaaaatcgtagcctaaacgacacaagatacatctcccgtttcttcgccaacttcatacgggaacacctcaaattcgcagactcagacgataaacaaaaagtgtacaccgtgaacggaggcgttacggcccacctacgaagtcgctgggatttcaacaaaaaccgcgaagagtccgatctacaccatgcagtcgacgctgcgatagtagcctgcaccactctaagcgacatcgcacgcgtcaccgcgttctaccagagaagagaacaggcaaaagaactggccaagaaaacagaaccccacttcccccaaccctggccgcacttcgccgacgaactgcgcgcacgcctcagcaaaaaccccaaagagtccataaaagccctaaacctcggtaactacgacaacgaaaaactagaatcgctacaaccagtattcgtatcccgcatgccaaaacgatccgtaacaggagccgcccaccaagaaactctaagacgatacatcggaatagatgaacgcagcggcaaaatccagactgtcgtcaaaaccaaactatccgagattaaactcgacgcatccggccacttcccgatgtatggcaaagaatcagacccacgcacgtatgaagcaataagactacgcctactagaacacaacaacgacccacgcaaagccttccaagagcccctttacaaaccgaagaaaaacggggaactaggacccatcatccgcacagtgaaaataatagacaccaaaaaccaggtcataccactgaacgacggcaaaaccgtcgcgtataatagcaacatcgtcagagtcgacgtattcgagaaggacggtaaatactactgcgtgcccgtatacaccatggacataatgaagaaagtcctgcccaacaaagctatcgaaccgaataagccctacagcgagtggaaggaaatgaccgaggactacacattccgattctcgctatacccgaacgacctaatccggatcgaactacccagagagaaaaccgtcaaaactaccgccggccatgagattaacataaaagacgtcttcgtttactacaaaacaatagattcagcgaccggcggcctcgaactcatctcccacgataacagcttttcgcttcgaggcatcggaagccgaacgctaaaacgcttcgagaaatatcaggtcgacgtgctgggcaacatatacaaagtacggggcgaaaaacgcgtaggactcgcaagctctgcacaccccgagacacgagagacgatcagaccactacaaagcacccgagactga

SEQ ID NO: 7369 - RNA, 3264 nt, synthetic construct
  misc_feature 1..3264: note = Cas9 variant
  source 1..3264: mol_type = other RNA
atgaagaagctggtgttaggcctggacatcggggtcgccagcgtgggctgggggatcatcgacgccgagaacggcgacgtggtcgacaccggggtgcgcctgttctccagccgggacgcgtccgagaacgagagccgccggacctcccgccagagccggcgcctctcccggcgcaagaagcaccggcgcgagcggatcaagcagctgctgctcgcccatgacatggacatctgcgacatcgtgaacgagaacccctacgagctgcgcgtcaaaggcctgaacgagaagctcgaggtgagcgagatctacgtggccctgacgcacctggccaagcggcgcggcgtctcctacctcgacgacgtggtggaggagggcgggaccatcaagagcgagcacctgaacaagaacatggaggagatcaagtccgggaagatgccgtgcgagatccagctggagcggttcgagaagtacggccaggtccgcgggatgatcgagatcaaccaggacaccgaggagagctccttcctagtgaacatcttccggaccagcgactacataaaggaggccaagacgattttggccacccagcagaagtttcacaagcagatcaccaacgagttcatcgacgagtacatccacatcatggcctccaagcgtgactacttcatcggccccggcaacgagaagtcccggaccgactacggggtgtaccgcacgaacggcgacacctgggacaacctgttcgaaatcctcatagggaagtgcagcgtcttccccgaggagacccgggccgcccgctcatcctacgtcgcgcaggagttcaacctgctgaacgacttaaacaacctgaagatcagcaacctggagagcggcaagctctccgctagccagaagcacgacatcgtggagaaggtgaagaactccaagaagttcggcaccaaggacctgctgaagtacatcgccagcgtgtgcgagtgcaaaatagaggacatcggtggctgccgcgtggacaagaatcggaagcccatcatgcacacgttcgagaactaccgcaaggtgcacaacgcgctcaacgaggccggggtggacctgcggctgtctgagaccgactacgacgaactcatgaagatcatgaccctgaacagcgagaccctggagatcaagaagcaatgcaaagagaagctcccgcaactgacggaggattacctgaacgtgtgcctcgtcctcaacaagaagggcgcgttctccgggtggcacgccctgagcctcaaggccatgaagctgatgatgcccgagctgtacggcacctccaagaaccaaatgcagatcatccacaccatgcagctcggcaaggcctacctgaagcctctgaaccagcagaagtacctcaacagcgaggccatactggaggagatctacaaccccatcgcggcccgctccatccggcagaccatcaaggtgacgaacgccatcctgaagaagtacgggcacctcgacagcgtcatcattgagatgccgcgcgactaccagacctccgaagacgagcggaagatgatcgagaagatgcagaaggagaacgagaaggagaagaaggccgccctaaagagagcgcgggaggagtaccccttccccgacgaggccttccgcaaccacaaggagctggccaccaagctgcggctctggtaccagcaggaccagttttgcgtgtacagcggccgcaagatctccgtggtcgacctggtgcggaaccccaaccagttcgagatcgaccacatcatcccgcagagcgtgtccctggacgacagcctcaacaacaaggtcctgtgcttctccgaggagaaccagaagaaaggtcagcagacccccttctactatcacaagggcaagagcgggaactggacgtacgagcagtacaagctgttcgtggagaagctgttcgacaagaagaagatcagcaacaagaagcgcgagttgctcctcttcgaggaggacatcaacaagtgggacgtgcggcgcggcttcatcgcccggaatctggtcgacacccgctacgcctcccgggtgatcctgaacagctaccagcagtacttcggcaaccacgagatgggaaccaaggtgaaggtcgtgcgcggcaagttcacctcccagctccgcaaaaagtggcggatcttcaaggaccgcaacgagagccactcccaccacgcgatcgacgccctgatcgtggccgccacggccaacctgcggctctggaagaagaacaccctgggggtcagcgacgagggcaaggtgtacgacaaggagaccggggagatcctgcccttcgagaagctcaccgagagcgagtacaacgagatgatgaacaaggagccctacctgaacttcaaaacgaagctgcagaacatcgagaccaaggtgaagtacagctaccgcgtctccaagaaggtgaaccggaagatcagcgacgccaccatctactccacccgcgagcgggacggcatcgactacatcgtgggcaagatcaagaacatttacgacgtcaagacgtacaaggaccagttcctcaagcgctacaagaagaacaaggagcagttcctgatgtaccagcacgacccgcagaccttcgccatcctggagaacatcatggccacctaccaggacgccgagaaccccttcctcgcgtacaagaaggagtacggcgtcattcggaaatacagcaaaaagggcgggggctcacccgtgaccagcctgaagttcatcgacaaggtcctgggccagaagatcgacctcaccgccaagaaccaggccgccctgcccaagaacaagaaggtggtgctgcaatccatcacgccgtaccgcgccgacgtctactacgacgagatcgacaagcggtaccacctcatcggtgtgaagtacagcctgttctccttcagcaagcagggctacgtgatcaaccccattgcgtaccagaagctgctcgagaaggaacaaatccacagcgagatgaagttctgcttctccctgtaccgcgaggacatcatcgagtttggggaggatcccgacagcctgacccggtaccgcttctggtccaagaacgagagcggcaagaacaaaatcgaggtcaagcccatcgagaagccaaacttcgagaagcagaccgtgctcaccattacgaagaagatcaagattctgaacaagtaccagaccgacgtgctggggaactccttcaaggcccaggaggagaaggacccccggaacatcgagtga

SEQ ID NO: 7370 - RNA, 3264 nt, synthetic construct
  misc_feature 1..3264: note = Cas9 variant
  source 1..3264: mol_type = other RNA
atgagatacaaaattggtctcgacatcggcattacctccgtagggtgggccgtcatgaacctcgacatcccgagaatcgaagacctaggcgtaaggattttcgacagagcggaaaacccccaaaccggcgaatcactagccctcccccgaaggttagctcggagcgcgcgacgtagactacgaagaaggaagcacagactagaacgcatccgtcgcctcgttatacgcgaaggcatcctcaccaaagaagaactcgacaaacttttcgaagagaaacacgaaatagacgtatggcagctccgagtcgaggccttggaccgcaaactaaacaatgacgagctcgcgcgagtactactacacctagccaaacgccggggattcaaatcgaaccgcaagagcgaacgctccaacaaagaaaactccaccatgctcaaacacatcgaggaaaatcgagccattctatcttcatatcgcactgttggcgaaatgatcgtcaaagaccccaagttcgcgctccacaaacggaacaaaggcgaaaactataccaacacaatagccagagacgacctggagcgggaaatccgcctgatattctccaaacaacgcgaatttggcaatatgagttgtacagaagagttcgaaaacgagtacatcacaatctgggccagccaacgcccggtggcgtcaaaggacgacatagaaaagaaagtgggcttctgcaccttcgaaccgaaagagaaaagagcacccaaagccacctacaccttccagtccttcatagcatgggaacacatcaacaagctccgcctcattagccccagcggtgcccgcggccttaccgacgaagaaagacgactcttgtacgaacaagcatttcagaaaaacaagatcacatatcacgacatacggacgctattacatttgccagacgacacctacttcaaaggcatcgtctatgaccggggagagagccgcaaacaaaacgaaaacatacgatttctggaactcgatgcataccaccaaatacgtaaggccgtcgacaaagtctacggaaagggtaaaagtagctccttcctgccgatcgactttgacacctttggatacgccttgaccctcttcaaagacgacgccgacatccactcgtacctacgaaatgaatacgagcaaaacgggaaacgaatgcccaacctcgccaataaagtctacgacaacgaactcatcgaagaactactaaacctgagcttcacgaagttcggccatctctccctaaaagccctccgcagcatcctcccctatatggaacaaggagaagtctacagcagcgcttgtgaacgcgcaggatacaccttcacaggacccaaaaagaaacagaaaacgatgctcctcccaaacatcccaccaatcgcaaacccggtcgtgatgcgcgcactaacccaagcccgaaaagtagtcaacgccatcataaagaaatacggctccccagtctcaatacacatagaactcgcacgcgacttgtcacaaacctttgacgaacgcagaaaaaccaagaaagaacaagacgaaaaccgtaagaaaaacgaaacagcaatccgacaactcatggagtacggactcaccctaaaccccaccggtcatgacatcgtcaaattcaaactctggtcggagcaaaacggtagatgcgcatacagccttcaacccatcgaaatagaaagactcctcgaacctgggtacgtcgaagtggatcacgtgataccgtactcgcgctcactcgacgactcctacacaaacaaagtactcgtcctcacccgcgaaaatcgagaaaaagggaaccgcatcccagccgaatacttaggcgtaggcaccgaaagatggcagcaattcgaaacattcgtgctgaccaacaaacaattctccaaaaagaaacgcgaccgactcctaaggctgcactacgacgaaaacgaagagaccgagttcaaaaaccgaaacctcaatgacacccgctacatcagcaggttcttcgcaaacttcatacgcgagcacctaaaattcgcagaaagcgacgataaacaaaaggtctacaccgtaaacggccgggtcacggcacatctacgcagccggtgggagttcaacaaaaaccgcgaagaatcagacctacaccacgccgtcgatgcagcaatcgtcgcctgtaccaccccctccgacatagccaaagtcacagcgttctaccaaagaagagaacagaacaaagaactagccaagaaaacggaaccgcacttcccacaaccctggcctcacttcgccgacgaactgagggcacgactcagcaaacacccaaaagaatcgatcaaagcactaaacctcggtaactatgacgaccaaaaactggaatccttacaacccgtattcgtcagccggatgccgaagcgaagcgtcacgggcgccgcgcaccaagaaaccctcagacgatacgtcgggatagacgaacggtcaggcaaaattcagacagtagtgaaaacaaagctgtcagaaatcaagctagacgcgagcggacattttcccatgtacggaaaagaatctgacccccgcacatacgaagcaatacgacaacgccttctcgagcacaacaatgatcccaagaaagcgttccaagaaccactctataaaccaaagaagaacggagagcctggcccggtcatacgcaccgtaaaaataatcgacaccaaaaaccaggtaataccgctcaacgacggcaaaaccgtagcatacaattcgaacatcgtccgagtagacgtgttcgaaaaggacggcaaatactactgcgtcccggtatacaccatggacatcatgaaaggaatactacccaacaaagccatagagcccaacaaaccctactccgaatggaaagaaatgaccgaggactacacattcagatttagtctatacccaaacgatctaatccgaatagaactaccccgtgagaaaacggtcaaaacggcagcaggcgaagaaatcaacgtgaaagacgtcttcgtctactacaaaacgatcgactcggcaaacggcgggctggaactaatcagccacgaccacagattctcgctcagaggggtcggatccagaacactcaaacgcttcgaaaaataccaagtcgatgtactgggaaacatatacaaagtaagaggcgagaaacgagtgggactagcatcaagcgcccactcgaagaccggcgagactgttcgtccactacaatccacccgagactga

SEQ ID NO: 7371 - RNA, 3264 nt, synthetic construct
  misc_feature 1..3264: note = Cas9 variant
  source 1..3264: mol_type = other RNA
atgcgatacaaaatcggcctcgacataggcatcacatcagtagggtgggccgttatgaatctagacatacccagaatcgaagacctgggcgtcaggatcttcgacagagccgagaacccccaaacaggagagtccctagccctaccacgacgtctagcacgcagtgcacgacgaaggctccgtcgccgcaaacaccgccttgaacgaatccgacgactcgtaatccgagaaggcatcctcaccaaagaagaactcgataagctctttgaagaaaaacacgaaatcgacgtgtggcagcttagagttgaggcactagatcggaaactaaacaacgacgaactcgccagagtactgctccacctggccaaacgccgcggcttcaagagcaaccggaaatccgaaagatcgaacaaagagaactcaacaatgcttaaacacatcgaagagaaccgcgcaatactttcctcgtaccgcaccgtgggcgaaatgatagtcaaagaccccaagttcgctctacacaaaaggaacaagggcgaaaactataccaacacgatagcccgagacgacctggaacgcgaaatcagactaatatttagcaaacaacgagaatttggaaacatgtcgtgcacagaagagttcgaaaacgaatatattacgatttgggcatcacagcgaccggtagcatcgaaggacgacatagaaaagaaagtgggcttctgcactttcgaacccaaagaaaaacgagcaccgaaagcaacgtataccttccagagcttcatagcttgggagcacatcaacaaactccgactgatatctccctccggagccagaggactcaccgacgaagaacgacgactgctctacgagcaagccttccagaaaaacaaaatcacctaccacgacatccgaaccctgctccatctaccagacgacacctacttcaaaggaatcgtctacgaccggggtgaatcgcgcaaacaaaacgaaaacatccggttcctcgagctggacgcctaccatcaaataagaaaagcagtcgacaaagtttatggaaaagggaaatcgtctagcttcctacccatagatttcgacacattcggctacgccctcacgctattcaaggacgacgcagacatccattcctacctccgcaacgagtacgaacaaaacggaaagagaatgccaaacctcgccaacaaagtctacgacaacgaactcatcgaagaactcctcaacctcagtttcaccaaattcggacacctcagtctcaaagccttacgtagcatcctcccatacatggaacaaggagaagtctacagctccgcctgcgaacgcgccggctacacgttcaccggacctaaaaagaaacagaaaaccatgctcttacccaacatcccacccatcgccaaccccgtcgtcatgagagccctcacccaagcccgaaaagtcgtgaacgcaatcatcaaaaagtacggctccccagtctcgatccacattgaactagcccgcgacctgagccagacattcgacgaacggcgcaagacaaagaaggaacaagacgaaaacaggaagaaaaacgaaacggccatacgtcaactcatggaatacggactgacactaaaccccactggacacgacatagtgaaattcaaactatggtcagaacagaacgggcgatgcgcatattcgctccaacctatcgaaatcgaacgcctgctagaaccaggctacgttgaggtcgatcacgtcataccctactcccgctctctagacgactcatacacaaacaaagttctggttctaacccgggagaaccgcgaaaaaggcaaccgcatcccggccgaatacctaggcgttggaacagagcgttggcagcagttcgagacgttcgtcttaaccaacaagcaattctctaagaagaaacgcgaccgactactcagactccactacgatgaaaacgaggaaacagagttcaaaaaccgcaacctcaacgacacacgatacatctccagattcttcgccaattttataagagaacacctgaaattcgccgaaagcgatgataaacagaaagtctacaccgtcaacggcagggtgacagcccatctccgcagccgctgggagttcaacaaaaaccgagaagaatccgaccttcaccatgccgtagacgccgtcatagtcgcctgcaccaccccaagcgacatcgccaaagtgactgccttctaccaacggcgggaacaaaacaaggagctcgccaagaaaacggaaccccacttcccacagccctggccacacttcgcagacgagctaagggcccggctctccaaacaccccaaagagagcataaaagccctcaacctaggaaactacgacgaccaaaaacttgagtcgctccaacccgtattcgtgagcaggatgcccaaacgttcggtaacaggcgcagcccaccaggagaccttacgacgctacgtgggcatcgacgagcggagcggaaaaatacaaaccgtcgtcaaaaccaaactaagcgagataaaactcgacgcaagcggacacttcccaatgtacggcaaggagtcagacccgcgaacctacgaggcaatacgacagaggctcctcgaacacaacaatgacccaaagaaggcattccaggaacctctatacaaacccaagaaaaacggagaaccaggccccgttatacgcacagttaaaatcatcgacaccaaaaaccaggtcatcccactaaatgacggcaagaccgtcgcatacaactcaaacatcgtacgcgtagacgtcttcgaaaaagacggaaaatactactgcgtaccggtgtacactatggacatcatgaagggcatactgccaaacaaagcgatagagcccaacaaaccatactccgaatggaaggaaatgactgaagactacacctttagattttcactctacccaaacgacctcattcgcattgaactgccacgcgagaaaacagtcaaaactgcagcaggagaagagattaacgtcaaggacgtattcgtttactacaaaacgatcgactcggcaaacggaggccttgagctaatctcacacgaccacagattcagcctacgaggcgtcggatcacggaccctaaaaagattcgagaaataccaagtcgacgtcctcggaaacatatacaaagtccgcggcgagaaacgcgtcggcctcgcatcctccgcccacagcaaaccaggaaaaaccatacgcccactccaatccacacgagactga

SEQ ID NO: 7372 - RNA, 3264 nt, synthetic construct
  misc_feature 1..3264: note = Cas9 variant
  source 1..3264: mol_type = other RNA
atgcgctacaagatcggactcgacataggcatcacctccgtcggctgggccgtcataaacctcgacataccacgcatagaagacctcggggtgcgaatattcgacagagcagagaacccccagaccggagaaagcctcgccctcccaagacgcctcgcacgaagcgcgagacgccgactacgccgcagaaaacatcgcctagaacgcatacgcaggctaataatccgcgagggcatactcacaaaggaggaacttgacaaactcttcgaagaaaaacacgaaatagacgtatggcagctccgcgtggaagccctggaccgcaaactcaacaacgacgaactagctcgcgtactgctacatttagccaaacgccgagggtttaaaagcaaccgaaaaagcgaacgcagcaacaaagaaaactccacgatgctcaaacacatagaggagaaccgtgcgatcctctccgggtatcgaacggtaggggaaatgatcgtcaaagatcccaaattcgccctccacaaacgcaacaaaggcgaaaactacaccaacacaatagctcgcgacgatctcgaacacgagatccggctaatcttcagcaagcaacgtgagttcggcaacatgtcatgcaccgaaaaattcgaaaatgaatacataaccatctgggccagccagagacctgtcgcaagcaaggacgacatcgaaaagaaagtcggcttctgcacgttcgaaccaaaagagaaacgagcaccgaaagccacctacacatttcagagcttcatagcatgggaacacatcaacaaactccgcctaatcttcccctccggcgcccgtggacttacagacgaggaaagacgccttctatacgaacaagcctttcagaaaaacaagatcacctaccacgacatccgcacactcctacacctacccgacgacacatacttcaagggcatcgtgtacgatagaggcgaaagccgcaaacaaaacgagaacatcagatttctcgaacttgacgcttaccaccaaatcagaaaagcagtagataaagtgtacggcaaaggcaagtctagctcattccttcccatcgacttcgacacattcggttacgccctcacactcttcaaggacgacgcagacatccatagctacctccgaaacgaatacgaacaaaacggaaaacgcatgccaaacctagccaacaaggtctacgataacgagctcatcgaggagctcctcaacctgtccttcacaaaattcggacacctatccctaaaagccctcagatccatactcccctacatggagcaaggcgaggtctatagctccgcctgcgaacgagccggatacacctttacaggccctaaaaagaagcaaaagacaatgctcctacccaacatccctccaatagctaatcccgtcgtcatgcgggccctaacccaagccaggaaagtagtaaacgcaatcatcaagaaatacggctccccagtatccatccacatagaactagcccgagatctctcccaaaccttcgacgaacgacgcaaaaccaagaaagaacaagacgagaaccgaaagaaaaacgaaaccgcaatcaggcaactcatggaatatggcctaacactcaaccctaccggccacgacatcgtcaaattcaaactctggtccgaacaaaacggaaggtgcgcatactccctgcaaccaatcgagatagaacgactcctagaaccaggctacgtagaggtcgaccacgtgattccctacagccgcagcctggacgacagctacacaaacaaagtactcgtcctgacaagagaaaaccgcgagaaaggcaatcgcataccagcagaatacctcggagtcgggacagaacgctggcaacaattcgaaaccttcgtccttaccaacaaacaattcagcaaaaagaaacgcgacagactactccgactgcactacgacgaaaacgaagagaccgaatttaaaaaccgcaacttaaacgacactagatacatcagccgtttcttcgccaatttcatcagagagcatctcaaattcgccgagagtgacgacaaacaaaaagtttacacagtgaacggacgggtcacgtcccacctacgttcaagatgggacttcaacaaaaaccgagaagaatccgatctgcaccatgcggtagatgcagcgattgtagcttgcactacaccatccgatatagccaaagtaacggcattctaccaacgacgcgaacaaaacaaagaactggccaagaaaaccgaaccacacttcccccaaccgtggccgcacttcgccgacgaactacgagcgcgcctctccaaacacccaaaagagagcatcaaagccctaaacctcggcaactacgatgaccaaaaattggaatctctccagcccgtcttcgtatcccgcatgccaaaaagaagcgttaccggggcggcccaccaggagacactcagaaggtacatcggcatcgacgaacgtagcggcaaaatacaaaccgtagtgaaaacaaaactaagcgaaatcaaacttgatgcctccggccatttccctatgtacgggaaggaaagcgatcctcgcacgtacgaggccataagacaacgcctactagaacacaacaatgaccctaagaaagcgttccaggaacctctttacaagccgaagaagaatggggaaccaggcccaattatcagaaccgtcaaaatcatagacacgaaaaaccaggtcattcccctcaacgatgggaaaacagtcgcctacaactcaaatatcgttcgagttgacgtctttgaaaaggacggaaaatactactgcgtgccagtgtataccatggatataatgaagggcatattaccaaacaaagccattgaacccaacaaaccgtactccgaatggaaagaaatgactgaagactacacatttcgcttctccctatatccaaacgacctcataagaatcgaattaccgcgggagaaaaccgtcaagaccacgaccggcgaagaaatcaacgtcaaagacgtcttcgtctactacaaaactattgattccgcgaccggagggctcgaactaatcagccacgacaaccgattcagcctgagaggggtcggcagccgaacccttaagcgcttcgaaaaataccaagttgacgtcctcggcaacatttacaaggtaagaggggagaaacgcgtaggactggcatcaagcgcccacagtaagacaggggaaacgatacgaccactccaatcaacacgcgactga

SEQ ID NO: 7373 - RNA, 3264 nt, synthetic construct
  misc_feature 1..3264: note = Cas9 variant
  source 1..3264: mol_type = other RNA
atgcgttacaaaatcggacttgacatcgggataacctccgtagggtgggccgttataaacctcgacatccctcgcatcgaagacctgggcgtacgaatattcgacagagccgaaaacccccagacgggagaaagcctggcgctccctcgcagactcgcccgaagtgccagaagaaggctgagaagacggaaacatcgcctcgaaaggatccgccggctgctaatccgtgaaggcgtgctaaccaaagaagaactggacaagctattcgaagagaaacatgaaatcgacgtctggcaactaagggtcgaggctctcgaccgtaagctaaacaatgacgagctagtcagagtcctgctgcacctagcaaaacgacgcggcttcaaaagcaaccgacagtcagaacgctcgaacaaagaaaactcaacaatgctcaaacacatagaagaaaacagagccatcctcagcggctaccgtaccgtcggcgaaatgatcgttaaagacccaaaattcgctctacacaaaagaaacaagggcgaaaactacaccaacaccatagcaagagacgacttagaacgcgagattcgcctcatcttctccaaacaacgcgagttcggcaacatgagctgtaccgaagagttcgaaaacgaatacatcgccatatgggcgtcccaacgccctgtcgcgtcaaaggacgacatcgaaaagaaagtcggattctgcaccttcgaacccaaagagaaacgagcccccaaagcaacttacacgttccagtcattcattgcctgggaacacataaataaactccgtctcatatccccaagcgggacgcggggcctcaccgacgaagaaaggagactcctctatgagcaggccttccagaaaaacaaaattacataccacgatatcagaacactactccacctacccgacgacacctatttcaaaggcatagtatacgactggggagagagcttaaagcagaatgaaaacatccgcttcctagaactggacgcgtaccatcaaatccgcaaagccatagacaaagtgtacggtaaaggcaaatcgtcctcattcctaccaatagacttcgacaccttcgggtacgccctcacactttttaaagacgacgcggacatccgatcttatctaagaaacgagtacgaacagaacggcaaacgcatcgccaacctcgcaaacaaagtctacgacaacgaacttatagaagaactcctgaacctcagcttcaccaaattcggacacttatcactcaaagccctacgcaacatcctaccatacatggagcagggagaagtatactcatccgcgtgcgagaaagccggctacacatttaccggccccaagaaaaagcagaaaactgtcctactcccgaccataccacccatcgtgaatcccgtcgtcatgcgggcacttacacaagcacgaaaggtcgtcaacgcgatcatcaagaaatacggctctcccgtgagcatccacatcgaactcgcacgcgacctcagccaaaccttcgacgaaaggagaaaaacaaaacgcgaacaagacgaaaaccgcaaacggaacgagaccgccatacgccaactaatggagtacggactaaccctgaaccctacaggcctcgacatagtaaaattcaaattatggagcgaacaaaacggacgctgcgcctactcgctccagcccatcgagatagaaagactactcgaacccggctacgtagaagtcgaccacgtcatcccctactcccggtcactggacgactcatacaccaacaaagtcctcgtactgaccaaggaaaaccgagaaaagggcaaccgcatacccgccgagtacctcggcgtcggcacagaacgttggcaacaattcgaaaccttcgtactcacaaacaaacaattcagcaagaagaaacgagaccgactcctacgactgcactacgacgaaaacgaagaaatggagttcaaaagccgtaacctcaacgatacgaggtatatatcccgcttcttcgccaatttcatccgagaacacctaaaattcgcggagagcgatgacaaacaaaaggtatacaccgtcaacggccgcgtcacgtcccacctacgctcacgctgggacttcaacaagaatagggaagaaagcgatctacaccacgcagtagacgcagcaatagtagcctgcaccacaccctccgatatcgcgaaagtcacagccttctaccagcgccgcgagcaaaacaaagaactggccaagaaaacggaaccccaattcccccaaccctggccacacttcgcggacgaacttcgggcacgactcagcaaacaccccaaagaaagcatcaaagccctaaacctcggcaactacgacgaccaaaaactcgagagcctccaacccgtattcgtcagcagaatgcccaaacgctcagtgaccggagcagcacaccaagaaaccctccggcgatacatcggtatcgacgaacggtcaggcaaaatccagaccgtcgtcaaaaccaaactctcggagataaaactagacgcgtcaggacacttcccgatgtacggcaaggagtcagaccctagaacatacgaggcaatccgccagcgattactcgaacacaacaatgaccccaaaaaggccttccaagagcctctctacaaacccaagaaaaacggggagccaggaccaatcatacgcacagtcaaaatcatcgacactaaaaaccaggtcatcccactaaatgacggaaaaacagtagcctacaactccaacatcgtgcgaatagacgtcttcgagaaagacggcaagtactactgcgtcccagtatacacaatggacatcatgaaaggggtactcccgaacaaagcaatagaacccaacaaaccatactctgagtggaaagagatgacagaagattacacattccgcttctctctctacccaaacgacctaatacgcatcgaactcccacgcgagaaaactgtcaaaaccgccgcgggcgaagaaattaacatcaaagacatgttcgtatattacaagacaatagactcggccaacgggggcctggaactcatctctcatgacaactcattctccctccgtggcgtcgggtcccgcacattaaaacgctttgaaaaataccaagtcgacgtactcggaaacatctataaagtacgcggcgaaaaacgggtgggcctggcgtcaagcgcccactccaaaactggcgaaactattcgcccactacagtcgacgagagactga

SEQ ID NO: 7374 - RNA, 3267 nt, synthetic construct
  misc_feature 1..3267: note = Cas9 variant
  source 1..3267: mol_type = other RNA
atgccaaaagagttcgacccactcaaacccgccaaataccgactagctctcgacatcggtagcaaaagcattggattcgccataatcttccttaaagaagacgtcaacaaactcctgaaaccctacgcaatcgttagaagcggagtccgcatattcggagacgggcgcaccccggcagccccaggccagctcggatcgtcgctggcagctgaaagaagagtcaaaagaagcatccgacggcaatatgccagaaagcgaaaacgactacagcgcctcctacgaaacctcaaggaactaggcttctttcccgacgactcaaagctgtgcaagagcttcgaggacttaaacccatatgaactgcgtcacaaaggcttaactaaagaactaaaaccccacgagttcgggaggctactcatgcacatggccaaaaaccgcggattccaaagcaacagaaaagtcgacctcctggcagacaacatagactcccaagcaaaagcggaaacaagcgccatgaagtcagccatcgccaccctacaaagccgcctcaacggcgagttcgaaacacttggcgcctacctctacgaacgattcaagaaaggagagacgataaagagttccaaaacccagaagggccagaaagccgagtacgagttctcaatcagcaggcgcatggtcaaacaagagttcgacagactttgggccgcccaagaacaattcaaccccgaactcttcaacgagcaagcgaagaacaccctaaaagacaccatattctttcaacggaacctactaccacagaaggtagggaagtgcacgttcctccccgaacacgaacgggcttccaaagcactaccctccagccaatacttccgcattatctccgaactcaacaagatctccttcaccgacgcggagggcttgatcctacctataagcctagagcaacgcaacaaactgctcaaatccctacggatcaaacaaaaactcagcttcgaccgcataagaacagaactcaacctagactcgacagtactaataaacctagaacacgcctcgaaagattccatagagggggacaagaccggttacctactatccaagaaagaatacttcggaccagcgtggagagacctgtccctcgaaacacaggacgcaatagtcacggcgttactaacgcacgaaaacgaagccgagctagtgcaaaagctagtagacgacttcaacatcgcacatgacgtcgcgaaagcactcgccaacgcccgcctggaaagccaatacatgcgactgtccaaagaggcaatcgaaaggctcatccccgaactcgaaaaaggagtcgactcccaagatggatacaaagtcccagtcaaataccacgaagcgacagaagccgcaggcttcggacaccacagcgcactacaggaaaactgggcagacttcccaacgctcgacctcaaacaactccactccgacgataacgacaaatacaccgtagccgaactcccccttccttactacgggaaagtgatcacccgacaagtagcattcgggaccggcgacgtaaacgaccccgtcgaaaaacgattcggaaaaatagctaaccccaccgtccatatctgcctaaaccaagttagggtgctactcgacgaaatcatagcgaagtacggttacccatacgaagtaaatatcgagctagcgagggaactcaagcaaaaccacgaacaacggcagcgatcgatcaaacaacaagccgcaaacaaaaaggagaacgaggaaatacgaagagaaatcaagcaagcgtataaggtagaaaaagcaagaataatcactgattccgaaatcagtcgcgcggacattgaaaagtggcgcctctggcgcagatcaaaatccaagctctgcgtctacagcggcaagaaaatttgcgaaacgatgatactcaacaacgaagtcgaagtagatcacatactaccccggagtcgcaccggcgacaattcataccaaaacaaagtcctcgtattaaacaaagcaaaccgaatcaaaagcaaccgcaccccatgggaggcgaaagaactattcgaagcccaaggatggagctacgaagacattttgaaccgcatgcgggcactcgacaaacaccaactcttccgcttcgccgagaactcaatggacatctgggataaaaactaccgttccttcgaggccagagccctcaacgacacccgctacatctccagagtcgtaaaagactacctcaaagtggtatgccacaaggaccgcatagtagtaagtaatggagcccacaccgcgctaataaggagggagttcggactcaacgatctcctcggcaagaagggagagaaaaaccgcgacgaccacaggcaccacgcgatagacgcgtgcgtcatcggtgcactagacagatcgatgctccgcaagctacagatcgctatggaagtagccgagaagcaaaacagcgcgaggaacttcgtcggactccaagaaccatggttcaacttctcaacccaagtgcgaagaagcatagggcaaatatacgtctcgcacaagccaaaccacaactacgaaggagaaatattcgaagcatctatctatggactacgcctgatatccgacaaaaggaccgaaaagtacgtcggaataaaacgaaacccggaaacaggcaagactgacaaacccaagaaatcagtcgtggtaatatccgacccaaaaacccaaaacagatacggtctccgccataaatttcattcggaaggcctgccaaagaaatattacggactgagcagctcaagcgtattctgcctggaaatctaccgagacgagaaaggaaactggcaggcgtacaccatcccccgatacgaagcataccggatcgtaaaacgccgcggagtaaacgcactatacgacaacaaacgatctaacttcgagggccgacctctcgtaatgagactgatgcgagatgactgtatcgcctttgagaaaaacggcgtcaaggaagtataccgaatacagaagatcaatggccttaagaagaacatcacgctcacgcgacacttcgacgcaaatgtggacgaccgctacaggcgcatgttaaaagcccaaaaggcagagaaagcgggtgaagacttcgactccgaagacctatgcgacgacctcgtcttctccagcttcggcgctagctcactctacagcaacaaagccagaaaggtcactataagccccatgggcgtacttcgagacccaggctttaaaggatga

SEQ ID NO: 7375 - RNA, 3267 nt, synthetic construct; identical to SEQ ID NO: 1575
  misc_feature 1..3267: note = Cas9 variant
  source 1..3267: mol_type = other RNA

SEQ ID NO: 7376 - RNA, 3267 nt, synthetic construct
  misc_feature 1..3267: note = Cas9 variant
  source 1..3267: mol_type = other RNA
atgaactacaagatggggctggatatcggaatcgccagcgtaggatgggccgtcatcaacctcgatctgaaacgaatcgaggacctgggtgtccggattttcgacaaggccgagcaccctcagaatggcgagtctctggcgttgccgcgacggatcgcacgcagcgcccgtcgccggctgcgccgccgaaagcatcggctcgagcgcattcggcgcctgctcgtgtccgagaacgttctaaccaaggaggagatgaacctgctgtttaagcagaagaaacaaatcgacgtgtggcagctccgggtagacgctctggagcgaaagctgaacaacgacgagctcgcgcgggtcctgctgcacctcgccaagcgccgtggcttcaagagcaaccgcaagtcagagcgtaactctaaagaatcgagcgagttcctgaaaaacattgaagagaaccaatccatactggcccaataccgcagcgtgggcgagatgattgtgaaagactcaaagttcgcctaccacaagcgcaacaagctcgatagctacagcaacatgattgcgcgggacgatctggagagggagataaagttaatttttgaaaagcagcgggagtttaataaccccgtctgtaccgagcgcctcgaggagaagtacctgaacatatggagttcccagcggcccttcgccagcaaggaggacatcgagaagaaggtaggcttctgcacgttcgagcccaaggaaaagcgcgccccaaaggccacctacaccttccagagtttcatcgtatgggagcacatcaacaaactccggcttgtaagcccggacgagaccagagccttaactgagatcgagagaaacctgctctataagcaagcattctccaagaacaagatgacctactacgacatcagaaagctgctgaacctcagcgatgacatccacttcaaggggctgctgtacgaccccaagtcttccctgaaacagatcgaaaatatacggttcctggagctggacagctaccacaagatccgcaaatgcatcgagaacgtctacggcaaggacggcatccggatgtttaatgagaccgacatcgataccttcggctacgccctcactatcttcaaagacgacgaggatatcgtggcctacctgcaaaacgagtacatcacgaagaacgggaaacgcgtaagcaaccttgccaacaaggtgtacgacaagagtctcatcgacgagctgctgaacctctcgttcagcaagttcgcccacctcagtatgaaggcgatcagaaacatcctaccctacatggagcaaggagagatctattcaaaggcctgcgagctcgccgggtacaacttcaccgggccgaagaagaaggagaaggccctgctgctgcccgtgatccctaacatagcaaatcccgtcgtgatgcgagccctaacacaatctcggaaagtcgtcaacgccataataaagaaatacggcagcccggtgtccattcacattgagctggcccgcgacctaagccactccttcgacgaacggaaaaagatccagaaggaccagacggagaaccgcaaaaagaatgagaccgccataaaacagctcatcgagtacgagttaaccaagaaccccaccgggctggatatagtgaaattcaagctctggagcgagcagcagggccgctgcatgtacagcctgaagcccattgagctggagcggctcctagagcccggctatgtcgaggtggaccacatcctaccttacagccgatccctcgacgacagctacgccaataaggtcctggtcctgacgaaagaaaacagggaaaaaggcaatcacacacccgtggaataccttgggctggggtccgagagatggaagaagttcgagaagttcgtacttgcgaacaaacagttcagcaagaagaagaagcagaacctcctgcggctccgctacgaggagaccgaagagaaggagttcaaggagcgcaacctcaacgataccagatacataagcaagttcttcgcgaacttcatcaaggaacacctcaagttcgcggacggcgacggcggccagaaggtgtacaccattaacgggaagatcaccgcccacctacggtcccgctgggacttcaataagaaccgggaagagtctgacctacaccatgcggtggacgctgtcatcgtggcctgcgccacacaagggatgatcaaaaagattaccgagttctacaaagcccgcgagcaaaacaaggagagcgctaagaagaaagagcccattttcccccaaccgtggccccatttcgccgacgagctgaaggcccggctgagtaagttcccccaggagtccatagaggccttcgcccttggcaactacgaccgcaagaagctggagtcgctccggcccgtatttgtatcacgcatgccgaagcggagcgttacgggggcggcccaccaggagaccctccgccgttgcgtgggtattgacgagcagtccgggaagattcaaaccgcggtcaagaccaagctgagcgacatcaagttagacaaggacggccacttccccatgtaccagaaggagtccgacccccgcacttatgaggccatacggcagcgcctcctggagcacaacaatgatcccaaaaaggccttccaggagccgctgtataagcccaagaaaaacggtgagcccgggccggtgatccggaccgtgaaaatcatcgacaccaagaacaaggtcgtgcacttagacggcagcaagacggtggcctacaactccaacatcgtgagaaccgacgtgtttgagaaggacgggaaatactactgcgtgcccgtctacaccatggacattatgaagggtaccctgcccaataaggctatcgaggccaataaaccctacagcgagtggaaggagatgacggaggagtacacgttccaattctccctgtttccgaacgacctcgtgcgcatcgtgctgcctcgggagaaaaccataaagacaagcacgaacgaagagatcataatcaaggacatcttcgcctactataagaccattgactctgcgaccgggggcctggagctcatcagccacgataggaacttcagcctgcgcggtgtcgggtctaaaaccctgaagcgcttcgagaagtaccaggtcgacgtgctcggcaacatccataaggtgaagggcgagaaacgggtggggctggccgcccccaccaaccagaagaaaggtaagaccgtggacagcctgcaaagtgtgagcgactga

SEQ ID NO: 7377 - RNA, 3270 nt, synthetic construct
  misc_feature 1..3270: note = Cas9 variant
  source 1..3270: mol_type = other RNA
atgaccgctttcaaaccaaatcccctcaactacatcctgggcctcgacatcggcattgcaagcgtaggctgggcaatggtagaaatagacgacaaagaaaaccccgtacgcctcatcgacctgggagtcagggtatttgaacgggcggaaatgcccaagactggagactcactagcggcagcccgcagactcgcccgctcggtacggagactcacaaggcgccgcgctcaccggcttctgcgcgccaggcgcctactaaagcacgaaggggtgctcaagccagaagacttcgatgagaacgggctagtcaaacccctaccctacataccaaaacaaccccgcaacacaccctggcagctaagggcagcggccttagaccgaaaactgaccccactcgaatgggcagccgtactacttcacctagtcaaacacagaggatatctaagtcagcgtaagaacgaaggagaaaccgacgacaaagagctaggagccctattaaaaggcgtagcggacaacacacacgccctacaagccggaaacttccgcacgccggccgaactcgcactgaacaaattcgaaaaagaatcaggccacatccgaaaccaacgcggcgactactcacacacattcagcagaaaagacttacaggcagagctcgtcctacttttcgaaaaacaaaaggagttcggaaacccctacgtaagcgacgatttaaagaacggcatcgaaaacttactcatgacccaacgcccagctctctccggagatgcgattcagaagatgctaggccactgcacgttcgaaccagcggaacccaaagcagcgaaaaacacctacactgccgaacgattcatctggttgacgaaactcaacaacctacgcatactaaaccaaggaaacgaacgcccactcacagacgcagaacgaaccacactgatggacgaaccctacaaaaagagcaaactaacgtacgctcaagcacgcaaactcctcgatctagacgatacggccttcttcaagggcctgcggtacggcaaagacaacgcagaaagcgcaaccctaatggaaatgaaggcctaccacgcaatctccagagcgctcgaaaaggaaggactcaaggacaagaaaagtccccttagccttagcccagaactacaagatgaaataggcacagccttcagcctcttcaaaacagatgaggaaatcaccggcagactcaagggctgcttacagcccgaaatactcgatgcactcctcaaacacatctccttcgacaaattcgtccaaatttcactcaaagcactacgccggatagtccccctcatggagcaaggaaaacgctatgatgaagcgtgcgccgaaatctatggcgaccaccatggacgcagaaatagcgaagagactctatacctcccgcccatacccgcagacgaaatacgcaacccagttgtcctccgagccctatcacaagccagaaaagtaataaacggggtagggcgacgctacggatcgccagcccgcatccacatagagacagctcgggaagtcgggaagtcattcaaggaccgaaaagagatcgaaaaacgccaagaggaaaaccgcaaagaccgggaaaaagccgcagcagagttccaagaatacttcccaaacttcgtaggagaaccaaagtctaaagacatcctgaagttacgactgtataggcaacaaaactgcaaatgcctctatagtggcaaagaaatcaatctcggtagactcaatgaaaaaggatatgtcgagatcgaccacgccctgcccttcagccgaacatgggacgacagcttcaacaacaaagtgctcgtgctcgggagtgaaaatcaaaacaaaggcaaccggacaccatatgaataccttaacggcaaagacaactcaagagaatggcaagagttcaaagcccgagttgagacgtcacggttcccccacagcaagaagcagcgaatcctcctacaaaaattcgatgaagaagggtttaaggaacgcaacctgaacgacaccaggtacgtcaaccgattcctctgtaagtttgtagcggaccacatgcagctcacagggaaaggcaaacgccgcgtcttcgcaagcaacggtcaaataaccaacctcctccgcgggttctggggcctgcgaaaggtcagggcagaaaacgacagacaccacgcactcgacgcggtagtcgtcgcgtgcagcacagtcgccatgcagcaaaggatcacccgcttcgtccgatacaaagaaatgaatgcattcgatggcaagaccgtcgacaaggaaacaggcgaagtcctccatcagaaaacacacttcccccaaccctgggagttcttcgcccaagaagtaatgatccgcgtgttcggcaaaccagacggcaagcccgaactagaagaagcagatacaccagaaaaactacgcgcccttctcgccgaaaagctctcaagccgaccagaagcggtccacgagtatgtagcacccctcttcgtctcacgagcacctaaccgcaaaatgagcggacaaggacacatggaaaccatcaaatcacccaagaggctagacgagggcatctccgtagtgcgcgtaccgctcacacaactaaaactcaaggacctggaaaagatggtaaaccgcgaacgcgagccaaaactctacgaagcgctaaaagcccgtcttgaagcccacaaagacgacccagcaaaagcattcgcggagccattctacaaacaagacaaggccggcaaccgtacccagcaagtgaaagccgtgcgaatcgaacaagtacagaaaaccggcgtctgggtgagaaaccaaaacggaatagccgacaacgccaccatggtacgagtagatgtatttgaaaaaggagggaaatactacctcgtgcccatatactcgtggcaagtagccaaaggcattttgcccgacaaagcaatcatagccttcaaagacgaagaggaatggcaacttatcgacgacagcttcaacttcaagttccccctacaccctaacgatctagtcgaagtgatcacaaagaaagctcgaatcttcgggtacttcgctagctgccaccgaggcaccggcaatataaacatccgaatccacgacctcgataataaagtaggcaaaaacggaatcctcgagggcataggcgtcaaaacagccctcagtttccaaaaataccaaatcgacgagctcgggaaagaaatacgaccctgccgcctgaagaaacgcccgcccgtccgatga

SEQ ID NO: 7378 - RNA, 3270 nt, synthetic construct
  misc_feature 1..3270: note = Cas9 variant
  source 1..3270: mol_type = other RNA
atgaacgtacgctataagataggactggatataggcatcacctcagtgggatgggcggtggtaaacctagacataccacggattgaggacctcggcgttagaatcttcgacagagccgagaacccccaaaccggcgaaagcctagctctaccgcgtcgactagcacgatccgctagacgccgactgcgcagacggaaacaccggctggagagaatccggcgcctactcatccgcgaaggcatccttatgaaagaggaactcgacaaactcttcgaggagcgacatgaaattgacgtatggcaactccgcgtcgaggccctcgaccgaaaactaaattccgacgaactcgcacgtgtgttactccacctcgcgaagcgaagaggattcaaaagtaaccgcaaatcagaacacaactcccgtgagaactccacgatgctaaaacacatcgaagaaaaccgggctatactctcatcataccgtacagtcgccgaaatgatcgttaaagaccccaagttcgccctccacaaaaggaacaaaggagagcactacacaaacaccatcgcccgggacgacctcgaacgagagatccagctcatattcacaaaacaacgcgagttcggcaacatgaactgcaccaaagagttcgaaaacgaatacatagcaatctgggcctctcagcgcccattcgcctcaaaggacgacatagaaaagaaagtcggattctgcacattcgaaccaaaagaaaaacgcgcccctaaagcaacatacacattccaatcattcatcgcctgggaacacataaacaaactccgtctcgtctcccccgccggaacccgtggcctgactgacgaagaacgcagactactctacgaacaggcattccaaaagaacaaaataacctaccacgatatacgcacgctactccgcctcccagacgacacgtacttcaaaggagtcgtctacgaccgaaacatgccactgaagcaaaacgaaaccatacgattcctcgaactcgacgcataccaccaaataagaaaggttatcgacaaagcctacggcaaaggcaaatcgagctcattcctacctatcgacttcgacacattcggttacgcactcacacttttcaaagacgacgcagacgtacgctcttacctccagaacgaatacgaacaaaatggcaagccgatgccaaacctcgccaacaaaacctacgacaacgaactcatagaggaactgctcaacttgagcttcaccaagttcggacacctctcactcaaagccctacacaacatcctaccctacatggaacaaggtgaagtatactcgtcagcctgcgagcgagccggatacaagtttaccggcccgcggaagaaacagaaaacaatgcttctcccaaacattccgagcattgctaaccccgtagtaatgcgcgcgctcacacaagcacgaaaagtcgtcaacgccatcataaagaaatacggctccccagtgagcatacacatcgaactggcacgagacctcagccaaacattcgacgagcgaagaaaaacaaagcgggaacaagacgaaaaccgaaagaaaaacgaaaccgccataagacaactaatggagtacggcctaacgctgaacccaaccggccacgacatagtcaaattcaaactatggtcagagcaaaatggaagatgcgcctactctctccaacccatcgaaatagagcgactcctcgaaccaggttacaccgaagtagatcacgtcattccctactccagatccctcgatgactcttacaccaacaaggttctagtactgaccaaggagaatcgagaaaagggcaatcgcactcccgccgaatacttaggagtcggaaccgagcgctggcaccaattcgaaacgttcgtgttaaccaacaaacagttctccaaaaagaaacgtgaccggctcctacgcctccactacgacgaaaacgaagagacggagttcaaaaaccggaacctaaacgacacacgctatatcagccgattcttcgcaaacttcataagagaacacctaaaattcgcggaaagcgatgacaaacaaaaggtatacaccgtgaacggccgcataaccgcacacctacgctcccggtgggagttcaacaaaaaccgtgaagaaagcgacctccaccacgccgtagacgcagcaattgtcgcgtgcaccacgccatcagacatagccaaaatcaccgcattctatcaacgacgcgaacagaacaaagaattagccaagaaaaccgaacctcacttcccccaaccctggcctcactttgccgacgaacttcgtgcccgactcagcaaacaccccaaagaatccatcaaggcactcaacttaggcaactatgacaacgagaaactagagtcactccacccagtgttcgtcagccgaatgcccaaacgatccgtaacaggagccgcccatcaagagaccctacgccgttacgtcgggatcgatgaacgaagcggaaaaatccagaccgtcgtaaagacaaagctctcagaaatcaaactcgacgcttcgggacatttccccatgtatggaaaagaaagcgacccgcgaacctacgaagcaatacgacaaagactcctagaacataacaacgaccctaagaaggccttccaagaacccctctataagcccaagaaaaacggagaacccggccccataatccgcacagtcaaaataatcgacacgaaaaaccaagtggtccccctgaacgacggcaagacagtcgcctataacagtaacatagtccgcgtagacgtgttcgaaaaagacggcaagtactactgcgttcccgtgtatacaatggacatcatgaaaggagttttaccaaacaaagcaatcgaacctaacaaaccatactcagaatggaaagaaatgacagaagattacaccttccaattcagtctgtacccaaatgaccttattcgcatcgagctaccaagagagaaagccatacgcacctcaacaggagaagaaatcaaaatcaaagacttcttcgcatactacaaaaccatccactcaggaaccgggggcatggaactcatatctcacgacagatccttctccctttccggagtcggaagcagaaccctaaaaagattcgaaaaataccaagtagacgtgctgggcaatatctacaaagtacgaggcgaaaaacgggtaggcctcgcctcttcagcgcactctaaaacaggaaaaacggtacgccccctccaaagcacacgcgactga

SEQ ID NO: 7379 - RNA, 3273 nt, synthetic construct
  misc_feature 1..3273: note = Cas9 variant
  source 1..3273: mol_type = other RNA
atgcgctggagactgggactggatatgggcgcaggatcactcggatggtgcgcagtcggattagacgatcagggatacccggacagcatactagcggcaggatcgcacatcttcggcgacgggcgagcaccatcacgcggagaccaacaaggcaccccgcttggggtcgaacggagggcagcaaaagcgatgcggcgtcggcgtgaccggttcctcggcagacaagctaaactcctagccagactcacgctcgcgggcttgttccctgccgaccccgttcgcgcgaaagcactcgagctcctagacccatacgtgctaagagcacgcgctctggacgaggcattgccaccgcaccaactaggacgagcgttcttccatctaaatcaacgccgaggattcaaaagcaacagaaaaacagacagaggcgtagacgacgaagcaggaaagatcgcaatcggaatcgaccgtctgagagcagccatagccgcagcagaggcccgcaccatgggtgagttcttgcacaaacgaagacaatcagcccctgacgtaaaccagatccccagcgtccgtacacgactcagaccagagacgggagaagaagccaaaggagacggatatgacttctacccaggccgagagctagtagaggaagagttcgacgccatatgggacgcacaagcgccacaccacccaagtctactcacgcccgacaaccgcgcccttctccacgaagccatcttctatcagcgcccacttaaggccccgaaaataggaaaatgcacgctactaaacaacgaaccacgactacctaaagcccatccactattccaacgaaggcgactcctcgaggaagtaaacgcactaagaatcgtgcgaccgggcgaggtggccaccaagttaacttgcgagcaaagggacctactcatgttaaaactaaaagataaagcaaaggtctcattcgaaaccctgcgaagcaaagtactgaaactagagcccgaggcccggtttaataaagaaggcgaaaaccgaacagaattagtgggagacgaggtgtgcgcacaaatgagcgcaaaaaccagattcggaaaggcgtgggctcacttcacagacgagaaacgttgggcgatactaagcagactcatagaagaggaagacgaagaaagactcgacacatggctcaggacagaacacggactggacgcagaacaagccagggcagtggcaggagcacggctcccggccggatttggacgattcggagaaacagccacgagacgcctaatcgccgcattgcaagcagaagtcatcgtgtactcagaggcggtagtggcggcaggcctaggtcatcactcagacatgcgaacaggcgaggtcctggcagaactcccatactacgggatgacactcgagaggcacctcctccccggaacgggcgacaaagcagatccagaagaattacgaatcggacgcctgacaaaccccacagtccacatcgctctcaatcgactaaggagaatagtaaatcgactcataaaaacctacggacgccctgaacaaatcgcgatcgaactcgggcgagaactcaaactcacagacgaggacaagcaaagactctcaaggcagaacaaccgcaacagagcggacgcagaagcgcgttcaaagaaacttgcagaactaggacaagcagacaacggagcaaaccgcgcacgcctaaaactgtgggaggaactaaacagagaaaacgccctagacagacgctgcatttacagcggacaacaaataagcattgcgatgctgttcagcgacgcagtagaagtcgatcacatactcccatttgacgctacattagacgattcgaacaacaacagaattttatgcctacgcgaatggaaccgaagaaaaagaaaacaaagcccctacgaagcatggggacacaccgactattggcctgacatcgccgcccgggccgcacgcctgcccaaagaaaaacgctggcgcttcgagccggacgccatgcagcgattctcggcagaagatcgtttcatcgcgcgacaccttgtagacactcaatacatgtcacgactagccagagaatacttagaagccttataccccgaaaaaggcgaaggaagcggccatgtctgggtatcacctgggagactaaccgaacttatacgaagaaaactcgggctgaacgagctactccccgatcacaacttcgccggagtgaaaaaccggctagaccaccgccaccacacgatcgacgcattcgtagtagcagtgaccgacagaagtctactacaagggatctcgagggcaagtgcactcgaaggagaagaaggccgagagagggtaatagtaccagaaccttgggacggcttcagagaagcactaagaacaacactcaacacgatcaccgtgtggcaccgccaggaccacggcacagcttcaaaagccggacttgcacagggccgagaccaaacggcaggaaaactccataacgacactgcctacggtctcacaggccgacaagacacaaaaggcaacgacctagtggtgagccgaaaaccactgatgagccttaaacccgcagacatcgagccagtccccgacgtggcaccaatcacaaaaggcgtgcgcgacagagacctaagaaaagcgctcgcacacttcacccaggccacagaggggaaagggttcctacaagccctcgaacgcttcacaagactcgggccactgcacttccgcgggataaggcgtgtccgccttatccagccactagcagtaataccaatcaaaggacccggaggagtcccatacaagggatatctaggaggtgagaactttcgctgtgacgtatgggaaatgccagacggagcctggaaacctgaagtaacatccatgtttcaagcgcaccaaccaggatggacgagtgcaatcagagcagcatgcccgaccgcacggaaggtactaagcctccacaagcgcgacatgatagccatagaaagggaggagggcgtacgcacgttaatggtggtagcccaaatatggagcaacggtcaagtaacactcgtggaaccacacgaagcaggcgacctgaacaagcggaacaaatcggaagatgacccgttcgggtactttatgccgaccgcaggaggcctaaaacgactaaaggcgcgacaagttcgcgtggacgaactaggacgagtacaggacccaggctttcccgcgcgcaaggccagacggaggacccgtcccaaacaagtggactga

SEQ ID NO: 7380 - RNA, 3273 nt, synthetic construct
  misc_feature 1..3273: note = Cas9 variant
  source 1..3273: mol_type = other RNA
atggactggcgcctaggacttgacctcggcgcaaattcactaggctgggcagcgctgaggttggaccgagctggcgaccccatcggcatactggccatgggatcccgcatcttctcagacgggcgcgaccccaagtccggagcctcccttgcggtagaccgccgagccgcacgcgcaatgcgtcgacgacgtgacagattcaaacaacgacaggcagcgcttctaaaatacctcataagagacgggctctttccagcagaccaagcagaccgacaacgactcgccgatgaagacccgtacgcactcagagcccgagctctggacgaagaattgtccctatttgaaataggcagagcactgttccacctgaaccaacgcagaggattccaaagcaatcgcaaggccgacagaggacaggacgacgaagcaggcaagatcgcagtcggggtcgatcggctaaatcagcagatggaggaacaaggcgcacgcacactgggagaatttctgcatcaaagacggcgcgcagcaacagacgccaaccacatacccagcgtccgcacacgactgagaccagagaccggcgaaggcgccaagggtgacggctacgacttctacccaagtcgagcactcatagcagaggagttcgaagaaatatgggcggcccaagcaccacactaccccgacacacttacccagcaagtacacgacagactatacgaaataatcttccaccaaaggcctctcagagcaccccaggtcggccaatgtacactcgtagccggagaaacccgactccccaaagcccacccacttttccagaaaaggcgactcctagaagaaataaacgcactaatgatagtccgaccaggggaaatagcacaacgcctaacaccggaagaaagagataccctatacctgaaactaaaagacaaacgaacagtcagcttcgcgacgctacgaaaaacactaaagctggactcagccgcacgtttcaataaggaatccgagaaccgaacagagctgaaaggagacgaggtcgcggcggaactgggagcaaaaacccgactaggaacgcggtggcaacacctgagcggggaccaacaatgggaagtagtacaccgcttaatggccctcgaaagccaggcagatgaggccgcattcagggactggatctcccagacgtacgacctactcccagaacaagcggctgccgtactaggagcgcgactcccacaaggccacgggcgcttcggaccaaccgcgaccaccaccctcattgacagtctgctacacgacaggacagaagacggccgcgtcgtagtatacagcgaagcagtacaacgaagcggactcggacaccacagcgatctcagacacgaccgagacgacgaagacgtcacagaactaccctattacggggtagcactagaaagacatatcatgcccgggacagcggaaccaacagatcccgaggaaatgcgcatcggcagactaacaaatccaactgtccacataggcctaaatcaactgcgacacgtagtaaaccgcctaatacgagcatatggcccacctaaagaaatagccatcgaactggctagagaactgaaactgagcgaagacgaaaagaagaaacgaaactccgaaaacagagacaaccgactggcagccgaaggtaggtcaaagaaactagaagaaatccgacagcgcgacaccggagccaacagagccctactaaaactatgggaggaactaaacccgggaaacgtcctcgacagaagatgcatatacaccggagaacagataagcatagacatgctattctccgacagggtcgaagtcgaccacatactgcccttcgcacagacccttgatgactccaacggcaacaaactcctatgcctgcgagaagcgaacagagaaaaacgaagaaggagcccatacgaagcatggggtcacaccgacaggtggcccgacatagccgagcgcgcatcaaggctaccaaaaccaaaaaggtggcgattcgaacccgacgccatgcaaagattcgcaacagaggacggcttcctggcccggcacctcgtcgacacacaatacctaggaagactagccagagaatacctttcgtggttatacccaggaaggggcgaaggcagtggacacgtatgggtaagcccaggccgcctaaccgaaatggtacgtcgcaaactaggactaaacgacctgctccccgaccataacttcggcgggggagcagaccagcccaaaaaccggctcgaccaccgacaccacgctatcgacgccctagtagtagcaatcgtagaccgcggcatgctccaagctatagcccgagcatcaggccaggacggaagtgagggtagagaaagaatccacatcccagcgccgtgggatggcttccgcgacgatctccgcgtcgccgtcaacggcatcatagtaagccacagaccagaccacgggacagtggccaaggcagggctagcacgaggaagagaccaaaccgccggcagactccacaacgacacagcctatggcctaacaggtgagaccgacgccaagggaaacagcatcgtagtacgaagaatacccctctcagcaatcaagaaacccgcagatatagcccgggtcagggacccactactacgcaacgcacttgccgagttcaccaaaggcctggacggaaaagcattcgaagcaaggataggaagattccacgaactgggcccactcctctatcgtgggatccgacgcgtacgggtcgtagaaaccctcactgtgatacccatcagagacgccgaaggacgagcatacaaaggctacaaaggcgacagcaactaccgctacgacgtctgggaaatgccggacggcaaatggcgttgccaagtagtcagcatgttcgacgcacaccagtccactgaacaggcaagaccacatccagcggcacgaaaaatactctcacttcagagaaacgacatcctggcgatagagagaacagaaggggaccgggaactcgtccgagtcgtcaaattcagcgagaaacaattcgccgtcgctcccccacacgaaggaggatcactcaaaacacgcgacggcaacgcagacgatccattccgatacctatacccctcgcctaacaccctaaaaggatggagggcgcgccaagtaagaatagacgaactgggtcgggtcctggacccgggattcccggcacgcaaatcggtaagacgaacccgacctcgagcagcccccgtggactga

SEQ ID NO: 7381 - RNA, 3276 nt, synthetic construct
  misc_feature 1..3276: note = Cas9 variant
  source 1..3276: mol_type = other RNA
atgtattccaacctcctattctctttcgacataggcaccaacagtatcggctggtgcgtattcgcactagacgaggcgggagagccgtatagaatagtagacctgggcgcgagaatatacgcggacggccgtgacccacaaagcaaaacaagcctagccgtagcccgaagagaggctcgcgctatgtcccgacgaagggacagatacctccgaaggcgaaaagcaacactcagaaccatgatcgagtacggcctcatgcccggcgacaaagcgggccaggaagcagtcctccgcgaaacgggcgaccgagagggcggcgacgagagcttcaacccgtacgccctacgagcaagggcactaagcgaaaaactacccccggcctacatcggaagagtcctattccacctcgggcagcgccgaggctttaaatcaaacagaaagacagacaggaaagacaacgacaaaggcaaaatagcactggggatagacgaactcacagcagccatgcatcgttcaggatcacccaccctaggagcatggctagccatgcgccgagcggaaggccacagtgtacgcctacgagcaggaagcgaggtgttcgacgccgaaggatacgcgttttacccagagagatctctactcgaagacgagtttcgccagatctgggacgcccaagccgtccaccaccccgatatactaacaccggagcggcgtgcacacctattccgggtgatgttctaccaacgaccgctaaagaaaccactcgtgggacggtgcagcttcaacccagcggaatttagactaagtagagcacaccctttgtttcaagagttccgcctctacaaagaaatcaatgacctcgaagtcgtcctaccagaccaatctcacagaaaactcacgttggacgaacgcaacgccctagtagcaaaactaaaaacgagccgcaaagcatcattctcagcactaagaaaaacactcaaactgacccctgacttggtcttcaacaaagagtcggaagcacgaaaagaactgctcggagacgagatctacagcgtactcgcagacgcgaaaatgttcggcgcacggtggggcggattttccagagctaggcaatgggaaataataacccggctcaaagaagaagaagaccccgcctcactttcaagttggttaaaaagtgagttcggactcgatgacgaacgagttaccgcaatagccaacgcctcccttccggacggatacggccgcctcggagaaacagcactcgcaagcatgctagaagaactcaagaccgccgtcataccagaaagcgaagcagcgcggctctgcggatacgaccacagcaacctggccaaggaacaagacgaaggactagacaccctaccggaataccaggaaatcctggagcgacacatacctcccggaacaggggatcccgacgacatctacgacctacggaaaggcagaatcacgaatcccactgtgcacataggactcaaccaactcagacgggtagtgaatgccctcatacaccggtttggcagaccccaacggatagtagtagagctagcccgtgacctccaactgtcagaaaaacaaaaggacgatgtaaaccgccgaatagccaaaaatacccgagaagcagagggaaggagccaaaaactcattgaaatgggacagctcgacacagggtacaatcgactactactaaaactatgggaagaactgaacctcgacaaacccgaagacagagtatgcatatattcaggcaagcccatcgggatagcaatgctattcagcggcgaggtcgacgtcgaccatatactaccgtggtcgaaaacactagacgactcgcaagccaacaaactcctatgcctaaagtccgcgaacaggcagaaaagaaaccggaccccaagcgacgtcccagaatggagagaccgatacgacgaagtactcgccagggccgcacgcctcccccgcaataaaaggtggcggttcgctgccgacgcaatgcaacaatttgaagccgaagggggctttctagcccgccaattaacggatacacaatacctctccagaatggccctagaatacctatccgcgctctacccctcggaagaagccgataagagcggggaactccgccaacgtaagcgagtacacgtcgtcccaggaagactcaccgaacttctacgccgaaattggggcctcaacacactactgccggaccacaatctaggcgaaatggcacaagaaaagaacagaagggatcaccggcaccacgcaatagacgccgcggtgataggaaccacctcacgctcactactgcaacgcatgagtggagcagcagcccgcctggacgatgtggcgttcgacgacctggtccgcacggttgtcaaagacaatcccccttggccaggatttcgagaagaactcctagccgccatcggaagagtaacggtaagccacaaacccgatcacggaaccgtctcacgggcagcatacgcgcaaggcaaaggccaaaccgcgggaaaacttcacaacgacacggcgtacggactcaccggcctagtagatgcaaaaggaagcccactcgtagtccgacgcaagccattcatggccttagaagttaaagacatagcatcgatacgcgataccgaactgcaaagtgcactatacggagcaataggcagcctcacagaaaagaaagcgctacaagaggcgctcatacgcttccgagacacccacccacaattcaaaggtatacgcagagtccgcgtgcttgaaaccctgtcagtcatcccaatcgtagaccgcgatggcaaagcctacaaaggatacaaaggcgatgctaactacaggtacgaggtctgggaaacactcgacggaaaatggcacacggaagtggtctccatgttcgacgcccaccaaccagggtggcaaagccccttccacaaacagaaccccgcagcccggcgagtgctgaagctgcagcagaacgacatggttgcctacgagcaccctgcggacgggtacaccatagcccgggtcgtcaaattcagtaacgacaaaagaatctacttcgcttcccaccgagagtcaggtagcctcaaagcgcgggacgcggataagggagaccccttcagttacttcgccaaagcaaacaacggcctccgcgacataaagtgccgacaagtacgaatcgacgccgccggacgcatattcgacccaggacctcaggaccgcgagacacgacaagccaacaaaggagtatga

SEQ ID NO: 7382 - RNA, 3279 nt, synthetic construct
  misc_feature 1..3279: note = Cas9 variant
  source 1..3279: mol_type = other RNA
atggcctacacaatgggaatcgacgtagggatagcatcctgcgggtgggcaatagtagacctcgaacgacaaaggattatagacatcggagtgcgcacattcgagaaagcagaaaacccgaaaaacggcgaagcactagcggtaccacgccgcgaagcccgctcctcacgccgccgactacgcagaaagaaacaccgcatcgaacggctaaaatacatgttcgtacgaaacggccttgccgtcgacatccaacacctcgagcaaacattacgaagccagaacgaaatcgacgtttggcagctacgcgtggacggacttgaccgcatgctcacgcagaaagagtggcttagggtacttatccacttggcacagcgccggggcttccaatccaacagaaaaacagacggctcaagcgaggacgggcaagtactcgtcaacgttacagaaaacgatcgcctaatggaagaaaaagactaccgcacagtcgcagaaatgatggtcaaagacgaaaagttcagcgaccacaaaagaaacaagaacggaaactaccacggcgtcgtctcacgcgcctcgctacttgtagaaatacacacgctattcgaatcccagcgccagcaccacaacttcctcgcctccaaggacttcgaactcgaatacataaatatatggtcatcgcaacgcccagtcgcaaccaaagaccaaatcgagaagatgatcgggacatgcacattcctgcccaaggaaaaacgagcgcctaaagcatcctggcacttccaatacttcatgcttcttcaaaccataaaccacatacgaataacaaacgcacaaggaactcgccccctcaacaaagaagagatagaacaggtagtcaatatggcgctcacaaaatccaaagtctcctaccacgacatacgaaaagtactcgacctctcagaagagtatcaattcgtaggcctcgactacgggaaagaagacgagaagaaaaaggttgagtccaaagagaccatcataaagctagacgactaccacaagctcaacaaaatcttcaacgaagtcgaacttgcaaagggggaaacttgggaagcagtcgattacgacacggtcgcttacgccctcacattcttcaaggacgacgaagacataagagattacctacagaacaagtacaaagactccaaaaaccgcctagtcaaaaacgtagcgaacaaagaatacaccaacgagctcatcgaaaaggtatccaccctcagcttccgaaaagtcggacacctgtctctgaaagcccttcgaaaaatcatccctttcctcgagcaaggaatgacctacgacaaggcctgccaagcagccggcttcaactttcagggaataagtaagaagaaaagatcagtagtcctaccggttattgaccaaataagcaacccagtagtaaaccgagccctcacgcagacccgaaaagtaatcaacgcactaataaagaaatacgggtcacccgaaacgatacacatagaaaccgccagagagctatcgaaacgtttcgacgagcgcaaaaacatcaccaaagactacaaagaaaaccgcgacaaaaacgaaagggctaagaaacacctatcagaactcggaatcatcaaccccacaggcctagatatcgtgaaatacaaactctggtgcgaacaacaggggcggtgcatgtactctaaccaacccatttccttcgagcgactgagggaatccggatacacggaagtagaccacatcataccgtactcaagaagcatgaacgacagttataacaacagagtactggtaatgacccgagagaaccgcgaaaaatccaaccaaaccccctacgagtacatgggcaacgacacccaacgatgggacgagttcgaacaacgcgtcacgacaaatccgcaaatcaaaaaggaaaaacgccagaacctcctactcaaaggctttacaaacaggcgagagctcgagatgctcgaaagaaacctcaacgacaccagacacataaccaagtacctcagccacttcatatccacaaacctcgagttcagcccaagcgacaagaagaagaaagtcgtaaacacgagcggacgcatcacgagccacctacgaagtcgctgggggctagagaaaaaccgagaacaaaacgacctgcaccacgccatggacgccgtagtcatagccgtaacatcagactccttcatacaacaagttacaaactactacaaacgaaaagaacgccgcgaacttaacggcgacgacaaattccccctcccgtggaagttcttccgcgaagaagtaatagcccgactgagccccaacccaaaggaacaaatcgaagcactgccaaaccacttctacagcgaagacgaactagcggacctacagcctattttcgtgtcacgtatgcccaaacgctctataacaggggaagcgcaccaagcccaattccgccgggtcgtgggcaaaacaaaagaaggcaaaaacatcacggccaagaaaactgccctggtcgacatctcgtacgacaaaaacggagacttcaacatgtacggccgagagaccgacccggccacttacgaagccattaaagagcgatacctcgagttcggaggcaacgcaaagaaagcgttctccacagacctccataaacccaaaaaggacggaacgaagggccccctcataaaatcggtgcgcatcatggaaaacaaaaccctggtgcacccagtcaacaaaggtaaaggggtagtttacaattcctcaattgtaagaactgacgtctttcaacgaaaagaaaaatactatctcctgcctgtgtacgtcacagacgtgaccaaaggcaaacttcccaacaaagtgatagcagccaagaaaggctacgacgactggatcgaagtagacgactccttcaccttcctctattccttgtacccaaacgatctcatcttcataagacaaaacccaaagaagaaaatttccctcaaaaagcggatcgaaagccactcaataagcgactccaaggaagttcaagaaattttaacatactacaagggagtagactcaagcaccgccgcaatcgagttcataacccacgacgggagctactacgcaaagggcgtcggagtccagaacttagactgtttcgagaaataccaagtcgacatccttggcaactactcaaaggtaaaaggcgagaaaagactggaactcgagacatccgacaacaatcacaaagggaaagacgtcaactcaataaaatccaccagcagatga

SEQ ID NO: 7383 - RNA, 3279 nt, synthetic construct
  misc_feature 1..3279: note = Cas9 variant
  source 1..3279: mol_type = other RNA
atgaagtacagcatcggcctggacatcgggatcgcctccgtgggctggagcgtcatcaacaaggacaaagagcgcatcgaggacatgggggtgcggatcttccagaaggccgagaaccccaaggacggctccagcctcgcgtccagccgccgggagaagcgcgggtcccggcgccggaaccgacggaaaaagcaccgccttgaccggatcaagaacatcctgtgcgaaagtggtctcgtgaaaaagaacgaaatcgagaaaatctacaagaacgcctacctgaaatccccttgggagctccgcgctaagagccttgaggccaagatctccaataaggagatcgcgcagatactgctgcacatcgcaaagcggcgcggtttcaagagcttccggaagaccgaccgcaatgccgacgacaccgggaagctactgtccgggatccaggagaacaagaagatcatggaggagaaggggtacctgacgatcggtgacatggtagccaaggaccccaagttcaacacccacgtgcggaataaggcagggagctacctattctccttcagccgcaaactgctggaggacgaagtgcggaagatccaggcgaagcagaaggaactcggcaacacccacttcaccgacgacgtcctagagaaatacatcgaggtgttcaactcccagcgcaacttcgacgagggccccagcaagccctccccctactacagcgagatcgggcagatcgccaagatgattggcaactgcacgttcgagagctccgagaagcggaccgccaagaacacctggagcggggagcgcttcgtcttcctgcagaagctcaacaacttcaggatcgtcggcctgtccggcaaacgacccctgactgaggaggagcgcgacatcgtggagaaggaggtgtacctcaagaaggaggtccggtacgagaagctgcgcaagatcctgtacctcaaggaagaggagcggttcggggacctgaactacagcaaggatgagaagcaggacaagaaaacggagaagaccaagttcatatccctgatcggcaactacaccatcaagaagttaaatctgagcgaaaagctgaagtccgagatcgaagaagacaagagcaagctcgacaagatcatcgagattctgaccttcaacaaatccgacaaaacgatcgagagcaacctgaagaagttagagctgtcccgcgaggatatcgagatcctgctcagcgaggagttctccgggaccctaaacctgagcctcaaggccatcaagaagatcctgccctacctggagaagggcctctcctacaatgaggcctgcgagaaggcggactacgactacaagaacaacgggatcaagttcaagcggggcgaactgctgccggtggtggacaaagacctcattgccaacccagtcgtgctgcgcgccatcagccagacccggaaggtggtcaacgccatcatcaggaagtacggcacgccccacaccatccacgtggaggtggcccgggacctggcgaagtcctacgacgaccgccagaccatcatcaaggagaataagaagcgggagctcgagaacgagaagaccaagaagtttatcagtgaggagtttgggatcaagaacgtcaagggcaagctgttactgaagtaccgcctctatcaggagcaggaggggcggtgtgcctactccaggaaggaactgagcctgagcgaggtgatcctcgacgagtccatgacagacatcgaccacatcatcccctacagccggtccatggacgacagctactccaacaaggtgctggttctgagcggcgagaaccgcaagaaatccaatctcttgcccaaggagtacttcgaccggcaggggcgcgactgggacacgttcgtgctcaacgtcaaggcaatgaagatccacccgcgcaagaagtccaacctcctgaaggagaagtttacgcgggaggacaataaggactggaagtcccgcgcactgaacgacacacggtatatcagccgcttcgtggctaactacctcgagaacgcgctggagtaccgggacgacagccccaagaagcgcgtgttcatgatccccggccagctgaccgcccagctccgggcccgctggcggctgaacaaagtcagggagaacggcgacctgcaccacgccctcgacgccgcggtggtggccgtcacggaccagaaggccatcaacaacatcagcaacatctcccggtacaaagagctgaaaaactgcaaggatgtgatccccagcatcgagtatcacgccgacgaggaaaccggggaggtgtacttcgaggaggtcaaggatacccgattcccgatgccctggtccggcttcgacctggagttgcaaaagcggctggagagcgagaacccccgcgaggagttctataacctgctctccgacaagcggtacctggggtggttcaactacgaggagggcttcatcgagaagctgcgccccgtgttcgtgagccggatgccgaatcgcggggtcaagggccaggcgcaccaggagacaatccggtcttccaagaagatcagcaaccagattgccgtgtccaagaagcccctcaacagtattaagctgaaggacctggaaaagatgcagggccgcgacacagaccggaagctctacgaggccctgaagaacagattagaggagtacgacgacaagcccgaaaaggccttcgccgagcccttctacaagccgaccaactccgggaagcgcggccctctcgtgcggggcatcaaggtcgaggagaagcagaacgtgggcgtctacgtcaacggcgggcaggcgagcaacggctccatggtgcgcatcgacgtgttccggaagaacgggaagttctacacggtccccatctacgtgcaccagaccctgctcaaggagctccccaaccgggccatcaacggcaagccgtacaaggactgggacctgatcgacgggagcttcgagtttctgtacagtttctacccgaacgacctcatcgaaatcgagttcggcaagagcaagtccatcaagaacgacaacaagctgacgaagaccgagatccccgaggtgaacctgagcgaggtcctcggctactacagggggatggatacctccaccggcgccgccacgatcgacacccaggacggaaagatccagatgcgcatcggcatcaaaaccgtgaagaacatcaagaaataccaggtggacgtcctggggaacgtttacaaggtgaagcgggagaaacgccagaccttctga

SEQ ID NO: 7384 - RNA, 3285 nt, synthetic construct
  misc_feature 1..3285: note = Cas9 variant
  source 1..3285: mol_type = other RNA
atgaaatccacgctcgcgatcgcatcaatcagctccctaggctgggttattgaacttggcgaaaatagaataatgcgactcggactcgacatcggcagtaccagcatagggtggtggatatacgaaaccacagacggacagataacctcggttatagacggaggcgtaagaatcttttccgacggccgagatcccaaatcaaaaggcagcctagcggtcgaccgcagagtagcccgcgcacaacgaagaagacgggatagatacctacgacgcaaagcagcgctcatgaaaagaatggccgaagtaggactgatgccaagcgatccaaaacaagcaaagcaacttgaggcgttggacccatatgaattacgcgcacgtgggcttgacgaaaccttggaactcacagaactcggccgcgcactgttccaccttaaccaaaggcgcggcttcaagagcaacagaaagactgacgcaggagacaacgaatcagggaagataatcgacgccacagcacggctagactgggcaatgcgggaccaccgcgcacgcacatacggcgagttcctccacatgcgacgccagaaggcagacaccccaaggacaacacccgctgtacgcacccgactcaccatcgcagcgagagacggcgccgaaaaagaagaaagtggctatgacttctacccagaccggcaacatctaagggacgagttcgacgccctctgggaagcccaagcagaataccacggcgtactcacggaggacctacgagacgaaatcggcaccataatattccaccaaagaccactcaagaccccgaaagtcgggaaatgcctattcacaaatgaagaaagggtagcaagcgctcacccacttaatcagcggcgcatattggtggaaacggtaaacgccctaagagtagcccaactcggggaagtagcccgcgccctcacactcgaggaaagagacactatcctccacgcactggacaacaaagcccacacgaaatcactaagtggaatgtcgattaaactaaaagcactcggaaaggtcataaagctcaggagcgggcaatacttcaccctcgaaacggcaaacagggacgccatcgcatgcgacccagtccgcgcttccctatcaaaacccgacagaatcggatcgtactggtcaacactagaccacaatgcacaatgggaagtagtaaacaggatcagagcggtacaaagcgatgcggaccacagggaactggtggcctggttagtcagccaacaccgcttggcagcggaacacgccgaaggcgcagcatacgcaccactacccgacggctactcaagactggggatcaccgcaacgaaacgcatcctcgcagccctagaggccaatgtaatcccctactcgaaagccgtagaaagctgcggatggcatcactccgacgaacgaactggcgaagtactcgaccgactaccatactacggggaaatactagacagacacgtaatcccaggaacctacgacgacagcgatgacgacataacacgcttcggacgcataacgaacccaacagtccatataggactgaaccaattacggcggctagtaaacagaatcatagaagttcacggaaaaccggacgaaatagtcgtcgaactcgcgagagacctgaaactaagccaagaccaaaaagccgacgtggaaagaactataaagaaaaacacccaagcggccataagacgaggcgaaaaactcgaggagatgggcgtgcctaacacaggaggcaaccgcatggtactaagactctgggaagacctcaacgacgacgacgtaatgaaacgattctgtccatacacagggcagaggatatcagcggggatgctattcgacggaagctgcgacgtagaccatatactccccttctctcgaacgttagacgacggattcaccaataaaaccctctgtctaaaagaagccaacagaaagaaaagaaactacgccccacacgaagcggcagagaaaggcctcctagaccgcgacgcaatggactccgtggccaaataccttccagataataaagcctggcgcttcgccccagacgcaatcgaaagatttgaaggggagcgtgacttcacagcacgagccctaaaagacacacaatacctaagccggctcgcccggacatatctggacgcactatacgatgggggagacgacaaaagccacgtctgggtggtaccgggacgcctgaccgagatgctcagaaggcactggggactcaacggcctggaggcgctcgcagacagcgacgagaaaaccgtaaaacgcaaaaaccgaaccgaccaccgccaccacgcgatagacgccgctgtagtagccgcgaccgacagatccctcatacagaaaatatcaaaaatcgccgcctccgacgaacaagccggcgcagaagacacccttaaaagcactcctcccccatgggactccttcagagacgacatcgcggcacagctccaaaacataaccgtaagccaccgggcagaccatggccgaacagactccctagccaaagggcgaggggaagacacaacctcaggagccctacacgaagccaccgcactcgggataatcgacgaaacccatgtaacagtgcgcatccccatcgaatccctaaagagcgggcacctaatagaaggctcacgcaatggatatatacgcgacccgtacctcagagaccaactcaccctggcaacaaagaacggcagcgacaaggacttcaccaccgtgttgcaaaaattctttgacagatcaaaacgatacggcggcacccggagagtccgaataatcaaaaccctccaagacacggccaggatcagcgtcccccacaacgcaccgataaaggcctacaaaggaggatcaaatcacgccttcgaaatatggcgcctaccgaacggaaaaatcgaatcccaggtaataaccacatgggaacatcataatctaacagaacccaaacgaccgcacccggctgcaaaacgaataatcaggctccataaaacggacatggtagcaatcgaacgtgacggaaaaacagtcatctgcttcgtccaaaagacagacccgtcaaatggcgcatttctcgtgccccacttcgaagcgaacgcagacggaagaaaacgcaaaaacgagcccgtcgaatggtatcaaatgtcggcaaacagcctcataaaggccgacctgcgacgagtgggcgtagacgaaatgggaagagtaagagatccggggccgccacccatacgatga

SEQ ID NO: 7385 - RNA, 3285 nt, synthetic construct
  misc_feature 1..3285: note = Cas9 variant
  source 1..3285: mol_type = other RNA
atgaagtatcgcgtcggattcgatctaggaacgaacagcctgggctgggcagtcgtccgcttaaacgcaagtggagaaccagacagaatagaagtcgccggaagccgcatattcagcgacggaagagaacccaaaagcggcgcatctctcgctggagctcgtcgggacgcgagagcgatgcgtcgccgaagggacagattcaaacagcgccaagccgcactcatcaaatacctcacccaagcaggatttttcccagccgacgaaagcgaacggaaagcactctcagcactcgatccatacgaactcagggccagagcactagacgaagccctccccctagcacacctcggcagagcactcttccaccttaatcaacgaaggggcttcaaatccaacaggaaaacagaccgaggcaaaaacgatgacacaggaaaaataaggataggcgtagcccgcctctacgagcaaatgcgagacgcagacgcccgcaccctcggagagttcctgcacaaacgccgagccgcagcctcagacccgaatgcaatacctcacgtgaggacaagaatcgtaaccctagccgcagaagatggcaaagccagtgacgtctatgacttttaccccgaccgacaaaccctagaagaagagttcgaagcaatctgggaagcccaaacctcacaccacccggaagcactaacggaggaaagacgagcccaattctacgaaattatcttccaccaacggccactgaaacaaccaaaaatcggattctgcaccttactaccgccagaaaagaggctacccaaggcacacccactcttccaacgacggcgcctactagaggaagtcaacgcgctgagaatagtactccccggcaaagaaacgcgagccctcgaaaaagcagagcgggacgctctgctcagtaaactaaaccagcgaaagaaagcagcatacgaaagcctcagaaaagcgttaaaactagatcccgacgcaaggttcaacaaggaaagcgacaacagagaagacatgataggggacgaaatcgcggcagagatggcccacaaaagccgattcggcaaagtctggctaggaatgtcagcagaagcccaagcccaagtcatagaaagactacggggtctggaatccgacgcagacgcggacgactttgaggcatggctaagagacgaccacgggctagcccaagaacaggcaaaagcagtcacagcggctaacttacccgaaggatacgggcgattcggggagactgcaacgagaaagctaattgcagcactagagcaagaagtaatagtgtactcagaggcagtacaacgcgccggcttaggtcaccacagcgacctccgagacggacaagtgtggacagacaagaagggaaatccagcactaccatattacggcgcagtactagaacgccacatagtaccaggcacagcagacccaaacgaaaccgacgacgcactaagaataggacgcctaactaatccaactgtacacataggtctaaaccagctccgaagagtcgtcaatgccctaatgcgacgctacggccaaccgcaagaaattgcaatagaactggcacgagaactcaaactctcggacgacagaaagaaagaaataaatactagaaacagggagaaccgaaaagcagccgaaaaacgatcccagaagctcagaaacataggacaagccgacaagggaggaaaccgcgcactgttaaaactatgggaagaattaaacccagaaaatgtcctagacagaagatgcgtctacacaggcagagtaatctcaatagacatgttgttctcaggggcagcagaggtggaccacatcctaccattcagcgtctcccttgacgactcgaacggaaaccgaatactatgtctgcgagaggtcaacagaattaaacgacaacgaacaccatgggaagccagagatgacctccgagcacattttggcccagacgcggggtgggaagcaatagcagcacgtgcagcgaggctgcccagggaaaaacggtggaggttcgaaccagacgcagcaaacagattcgacgcccagggaggcttcctagcgagacatcttaccgacacacaacacctaagtaggctagctcgctcctacctgagcgcactctaccccgaaacgggagaggggagtgggcacgtatgggtgagcccgggccgactcacagagatgctaagaagggcctggtcgctcaaccaccatctaccagaccacaacattgccggcgcggcaaatcaacccaagaacagaaaagaccacaggcaccacgcaatagatgcaatagtagtcgccctagcagatagggcaatgctcaacagaatcgcacgagaatccggcaaggaaggccatgaggcagcaggcaggctcgtagccagtatacccgaaccatgggaaggattctcagacgaagtaggcagagcagtaagagcaataacagtatcacaccgaccagatcatggaaccgcaagcaaagccggacgagcgaaagacaaggacgcaacagcaggacgcttacacaacgaaaccgcctacggtttgactggagaaaaagacgcacgcggcctcgacattgtggtgacgcgaaagccactgtccgcgttcaagaaatccgccgacctagacgccataagagacgacgacctaaaacaaaaactcaaagcctgggcagcaggcaaggaaggaggggcattcgaacaggcgatgcggtcattcggagacccagaacggggacccagaagtcatccaggacttcgccggatacgagtgacggaacccctgagcgtaataccgatcagagatagggatgggcgaccatacaaagcctacaaaggggacagcaattaccgattcgacatctgggaactaaaaacgggcaaatggaaggacgaggtcgtctcaatgttcgaagcacaccgaccaaactggaccagcccgatcagagccggcaatcccacagcacgaaaagtcctaagcgtgcgccaaaacgatgtaatcgcgatagaaagggaaaacggcccagaactgatgcgagtagtgaaattcagcgcaggcagtctggctctagctccaccacaagaggcaggaagcctcaaagcacgagacgcagacaaaaacgacccattcaaatacgtatatggcagccccagttcactgcaacggtggaaagccagacaggtaagaatagatgaactaggacgagtattcgacccgggcttcgcagtaaggtcacgaaggagctccgagtga

SEQ ID NO: 7386 - RNA, 3291 nt, synthetic construct
  misc_feature 1..3291: note = Cas9 variant
  source 1..3291: mol_type = other RNA
atgaaaaacatattcagctttgatatagggaccaacagcataggatgggccgtcctggcactagacggaaacggcgaccccgtgcgaatcgccgacgccggggtccgaatattctccgacggcagggacccaaaatcaaaagcctcgttagcagaagcccggcgtatggcaagggcaatgagccgccgacgagatagaacactacggcgcaaacgcgccaccttacggacactggcagaaatcgggctaatgccagacacgagctccgcgcggcaggcacaactccgtgaaacatccgaccccaagtccggcagcggacaactgacccgaaacccatacgcactccgagcactggccctagaggaaaaactaccactgttccacatcggacgggccctctaccacctcggacagcgaaggggattccaaagcaacagaaagacggacagaaaggacaacgacaaggggaaaatcgctctgggaattgaagaactccacgcggccatgcgacaggacggcgcacagacctatgggcaatggctagcccgcagacacgctctagggcaagcagtacgactaagaagcggagcgctagacctagaaggagaaggctacgcattctatccagaacgcaaactcctcgaagacgagttccaccgaatatgggaggcacaagcgaggcactaccccgatatcttaacacccgagcgacgagaccacctgtttacggtcatgttcttccaaaggccgctcaagaagcccaaagtaggcaagtgcagcttcaataatcaagaagaaagactcagtaaagcacacccactcttccaagagttcagactctacaaagaagttaacgaactagaaatagtagaacccgacctcacgcacaagaaacttacactggatcaacgcaacgctctagtcaagaaactccaagtatcacgcgaagcatccttcgcagccctaagaaaagtactaaaactacgaccagatcagagactgaacaaagaaagcgagtcgcgcaccaaactcaaaggcaacgaggtctacgcagttctgagcgacaaaacaagattcgggccccgctggggaaccttcagccaagctgaacaatgggcaattatagagagacttaaagaagaggaggacccaggacgattgttcgcatggcttagaagcgcattcgggatcgaaggcgaacaggcagcggacatcgcaaacgtacatctgcccgagggacacggacgcctcggcaaaacggccctagaggcaatgctcgaggaactgaaagcagaagtaatcaccgaagcagaagcggccaaaagatgcggctacgaccacgcacgcctcgggggcggaagcgacgaaggagaacccgaattaccaccctaccaggagatattgcaacaccgcatacccccaggcacgaacaaccccgacgacccttacgacatcgaaaaaggcagattcacgaaccccacagtacacatcgcactgaaccaactgcgacacgtaatgaacacgctgatccgacggtatggaaaaccggcccaaatcgccgttgaactagcccgagacttgaaactgtcggagcgacaaaaagaagaggtgaacagaaccatagcaagaaatacccgcgacgcagaacgcagaggcaaaacactggaagaaaacaggataccaaacacaggatacaacaggacactgcttcgcctgtgggaggaactaaaccccggcaaagtagaggaccgatgctgcatatatacaggaaaaccaatctcaataagcatgttattctcgggggaagtcgacatcgaccacatcctgccctggagccgcacgcttgacgacagccacgggaacaagctgctatgcctacgtgaagcaaatcgggtcaaaagaaaccgagcccctgcagacgtaacagaatggagagacaattacgacgaaatactcagcagagccgcgagactaccacaaaacaaacgcgaccggttcgcaccggacgccatggagaggttcgaaaaagccggaggattcctagcacgccaactcaccgacacccaatacctcagccgaatggccctcgaataccttgcgtgcctctttcccgccgaagaaatggatggcttcggagaactaaggagacaccggtacataaatgtatgcccaggccgactcaccgagatgctcagacgcaactggggtctaaacagcatattatccgactcacaactgggcgaaaccgcccaagagaaaaaccgcaaggaccaccgccaccacgccatcgatgcaatcgtaatcggagtcaccggacgatcgctactcaacagaatcagttacgcagcaggaagattagaagcccaacaactggaaacgctagtcaaagaagcagccgccacaaacaaaccgtgggacggattcagagaagacgtagcaaaagtggtaggcgggatcatcgtgagccacaaacccgatcacgggacggctggacgcaaagcaaaagacccagccagacaacaaaccgcaggccgactgcacaacgacaccgcatacgggctcactggggaaaccgacgcccgagggaacacgatcgttgtccgacggaaacccttcctaagcctcacctctaaagacatacccagcataagagacgaagcactaagagcagtactggaacaacacttacggggaatacccgacggcaaggctttccaggcagcgctcgatgcattccgaaaacaaaagggctttcaccactaccatggaatccgacacgtccgactaactgagcctctatcagtcattggaattaaggaccgggacggtaaagtatacaaaggctacaaaggcgacgccaaccagaggtatgacgtatgggaaacactggacgggaaatggcacgcagaggtagtcagcatgttcgatgcacaccaaccaggctggcaatcacgattccacgccgagaacccaacagcccgtagagtgctgcgactccaacaagacgacatggtagcgctaaatgccccagacggcggccggctacttgtacgagtggtaaaattccgccaaaacggacaaatcacattcgcgggacacaacgaatccggaaacctaaaagcccgcgacgctgcctccaacgaacaagaccccttcaaatacatctcgcgcatggcatctagcctaaaagactgcggatgccggcaagtccgcattgacgcaaccggccaggtattcgacccaggtccccaggaccgggcaagccggctacaaaaacaaagtaaacgttga

SEQ ID NO: 7387 - RNA, 3294 nt, synthetic construct
  misc_feature 1..3294: note = Cas9 variant
  source 1..3294: mol_type = other RNA
atgaagaagcaaccacagcgctacatcttaggacttgacctaggaatcgcatcagtgggatgggctctaattctagtagacggagcagagaaccccgtaggtttgctagattgcggtgtaagaacttttgaaagagctgaagtaccaaaaacaggcgactcacttgctctagcccggagacaagcgcgatccgtcagaagactcataagacgccgcgcccaccgactactccgacttcgaagactgctaaaaagagagggaatcctatcagcggctgactttaactctgacggcctcccgaacctccccatagacgcatggcagctacgcgtcgccggcttagaacggaaactcacaaatcaagaatgggcagcggtactgctccacctcgtaaagcaccgaggatacttatcacaaagaaaatcggaaacccagaccgaaaacaaagaactcggacgcctacttgccggagtcgcagaaaactccaaactgctctccgaaagcagcgagcagtaccgcacccctgccgaactagccgttaaacttttcgcagaacaatccgggcacctacgaaacaagggcggtgaatacacccacaccttcaacagactggacctacaaaaagagctacacctactcttcgaacgtcaatacgcgctaggtaacccctttgccagcgccgagctacaaagcaaagtggacgagctcctaatgacccaacgatccgccctccaaggcgaggcagtcctgaaaatgctcggaaagtgcacattcgaaccctccgaatacaaggcagctaaaaatacatacagcgcagaacgtttcatctggctgaccaaactcaacaacctccgcatcctgtacaacggcgaagaacgggccctcgacgaaggtgatcgcaaaaagctgctggacgagccgtacaagaaagcaaaactcacgtacaaacaagtccggtcaatactaaatcttcccgagagcgccgtcttcaaaggcctacgttacggcaaagactccgacggcctcaaagccgaaaacggcacgctaatggagatgaaagcctaccacaagattagaacaatcctagataaagccggactgaagggggaatgggaaaaccgaatcagaaacccagaaatcctcgacaagataggaaccgcattctcactctacaagacagacgaagacatccaggccgccctcgcagacctacgcctcccagagaacgtcctggatgccctactagccggactcaacttcgacaaattcatacagctttctctcaaagccctgcggaatatactccccctcatggagcggggcataaggtatgacgaagcctgcaaggaagtctacggtgaccaccgagccctagcagagtccaaaaaccaagtacttctcccaccaatcccagcagacgaaatccgtaacccggtggtcctgcgaaccctaacgcaagcccgcaaagtaatcaacgccataatacgtcggtacgggtcaccccaacgggtacacatagaaaccgcgcgcgagctagggaaatccaaacaagaacgcgataaaatcgaccggaaaaacaaggaaaaccagaacgatcgaaatagactagcatcagacatccgaaagcacttcaacttcgaaccaaccccgaaagacatactgaagctacgactttacgaacaacaacacggaaaatgcctctactctgacctacgagaagaaaaaggagaatgcctatataccggcaacgtgatcgaactacaccgcctgttcgaagacggctacgtagaaatcgaccacgccctaccgctgagcagaacctgggacaactcactcaacaacaaagtcctggtcctgaaatcctccaaccaaaataaagggaacaaaaccccatacgaatggctagacggcgcgaacaactcccgacgatggagggagttccaagcccgcgtccaaggctgccacttcccctacgtcaagaaacagcgaatccagacagcaaaactggacagcaaagccgaacaaggattcctcgaacgcaacctaaacgacactcgatacataagcaaattcatgtgccaattcataacggccaacctcagactcgcagaaaccagcaacgcactcatggaagaagtagcgggtgaaaacccctactggaaagaacgtaaacgccaacgcgtattcgcaccctccggttccataatcgccctcctcagaggcttgtggggactgaagaaagtaagagaagataacgaccggcaccacgcactagacgccatcgttgtcgcctgctccacggtgtccatgcaacagaaaattacaaaagccatgcaacgacgagaaaccctcgaaaccgtcgactcagagaccggggaggtcaaaacccggataccccaaccatgggacttcttccgccaggaagtcatgatccgcgttttctccgacagtccccgagaggaactcgccgaaaaactcaactcccgccccgaagcacttcacgacttcgtatcacccctattcgtatcccgagcacccaaccgaaaaatgaccggacaaggccatctcgaaacagtcaaaagcgcaaaacgtctatccgagaacataagcgtcgtacgaaaaccattgaccgcactgaaactaaaagacatagagaacatcgtcggctaccccgaccgagagcccgcactctaccaggccctaagagaacgccttctcgcccacaaagacgatccagtgaaagccttcgcagacaaacctttctacaagcccgctaaggacgggggacagggatcactcgtgaaagccgtccgaatcatcgaaaacacgaagcacggattaaaaatccgtaacggcatcaccgacactaacggagacatggtcagaacggacgtctaccagaaaacagacaagaaaggaaaaaggcaatacttcatcgtacccgtctacgcatggcaagtagaaaagaacgagctgccaacggtggactgcaaaggctacgagatcgacgacaactacgagttctgcttttcactttataaatacgacctcatagaaatccaaaaccccaatgacattaaccaagaattacgggcttactacatcaactgcgactcgtccgacggccgcttctggttagcttaccacgacaaatccgctaaagaacaacagttcaggatctccacacagaatcagccgatcatcaaaaagtaccaagtcgacacactcggaaaagaaataaggctttgcaaagcagaaaagcgcacggccctaaacggcaagaagaaaaagtga

SEQ ID NO: 7388 - RNA, 3294 nt, synthetic construct
  misc_feature 1..3294: note = Cas9 variant
  source 1..3294: mol_type = other RNA
atgggcaagggagatatactgttcagctttgacatagggaccaacagcatagggtggtgcgtcttcgcactcagcgacaacggagacccatgccgcatactcgacgcaaatgcacgaatattcgctgacggacgagagcctaaaagtggaaactcgctagctgaaggcagacgagccgctcgagccatggcacggcgccgcgaccgctacaaaaggcgaagaaaagccgtcctaagaaccctcacagaatacgggctaatgccggccgaccctaaggcaagacaggccctcgtagccaagaccggggaccggggcccaaaaagtgaagaagcactagcggacgtgtactccctacgagcccgagcattaatggagaagctaccattacaccacataggcagagcattgttccacctaaaccagcgtcggggatttaagagcaatcgaaaaacggaccgaaaatcaaacgaaaaaggagcaatagaaacaggagtcaaccgactcctcgaagaaatgagagacacgggagccccaaccttgggagcatacctagccaagcgcagatccgatgggcgcccagtacgcgttcgagccggcgcgtcagaacaagaagccgaagacgggaaaccagccaaaacagcatacgacttctaccccgtacgacggctgctagaagaagagttcgacgcgatctgggagaaacaatactcataccacccagaagtcctgacggaggaaaggagaggccacctattccgagtcatgttccaccagagaccactaaaacccgcaatagtagggcgatgtagcttcaacagtgctgagacacgcctggccaaagcacacccactcttccaggagttcaggctgtacaaagaagtaaacgaactagaagttgtaatgccagatcaatcacaccgcaaactcacactgccggagagagaccggctcgtcctaaagctccggggccagcgcaaggccacatacgcagccctaagaaaagaactcagactgagagacctccgcttcaataaagagacggaaaacagaacagacatgatgggggacgaagtaaccgcagcactagcagacaaagcagtcttcggaaatcgctggtcaggattcagcaccgacgagaagtggagaatcgtcgaacgactgcgggaagaagaagacccattcgccttacacgaatggctggtaagcgagcacggcctcagcgatgcagaagccgagcaagcagcaaaagttcacctaccggacggctacggccgacttggtccaacggccgtcagcacaatgctagaagaactaaaagcagacgtaattaccgaagccgacgctgcccggctagcgggctacgaccacagcctcgcccgcgcggacgaagacggactcgatcggctacccaaatatcaagaggtcctcgagcgaagaatcccaccaggaacaaacgacccagatgacccctacgatatcgcgaagggacgcatcaccaaccccacagtacacatagcccttaatcaatttaggcacgtagttaacgcgctagcacgtagattcggcaaaccggatcaaatagcaatagaactcgcaagggaactgaaactcaacgacagacaaaaggacgaagtaaatcgagtaatcggccgcaacacaagggccgcagccttaagatctcagaaactccgcgatatcggacaaaaagacaacgggtacaatagggcgctcctgaaactatgggaggagctaaacccggacaaaccagaagaccgagtgtgcgtctacacagggcgaccgatatgcatatcaatgttattctcaggagaagtggatgtagatcacatactaccgtggagccgcacaatggacgactcccaagcaaacaggatcctgtgcgtcgtagaagccaatagagtaaaagcgaaccgagcacccgccgaagtagccgaatggggcggacgctacgacgaaatactggaaagagcagccagactcccccggaacaaacgatggagattcgcgagagacgcgatggagaaatacaaagaaaacgaagggttcctcgccagacagctaacagacacccaatacctatccagattagcaagagaatacgcagaagcactgtatcccaccgaagaaccagacagactaggcgaactgcgtagacgaaaccacgtccgggtaataccaggacgcctaaccgaaatgctgcgcagaggatggggtctaaatgcactactacccgaccacaactttggggccgggcaagctaaaaaccgaaaagaccacagacaccacgcaatcgatgccgccgtagtaggcgtaaccacacgcggtctactacagcgtataagtacagaagcaggcttgcgtgagaaactcgcactggaagaaacaattgcagacataccgatgccatggccaggatttagagaagaactaaaagccgcaatagaccgcgcggtggtaagtcacaaaccagaccacggcaccctgccaaagccgggcgaacacggacgaacggcgggccaacttcacaacgacacggcttacgggataacgggagagaccgacgcccgtggcaaccccatcgtcgtccgcaggaagccattcctatcgctcaccgacaaagacataccaagcatacgagacacagagctacggggacgagtctatagcgcaaccagcggccttagcgggcgtgagctatcagcagccctagactactttcgcaaaaccgacaaacaattccggggcatcagacacgtccgagtgactgagagcttgtcggtgataccaatccgcgacagagacggaaatatctacaaaggctacaaaggagacgcaaacttccggtacgacgtatgggaattaccagacgggaaatggaaggcggacgtcgtaaccatgttcgatgcgcaccgccccgaccgagcagcagaagaaagaagaccccacccagccgcccggaaggtcctatcactgaaacagaatgacatggtcgcatgcgaacaccccaaagacggctacacgatcggaagagtcgtaaaattcaacacagctggacaaatatacttcgccgcacataatgaaggaggcagcctcaaggctcgagatgcggacagagccgaccccttcaaatacttttctaaaagtgcgagtgggctaaaagagatagccgcaaggcaagtcaggatagatgcaacaggacaagtcctggacccagggcctcaagaccgagaatccaggttagccagaaataagcgacttgagagagaaagagcctga

SEQ ID NO: 7389 - RNA, 3303 nt, synthetic construct
  misc_feature 1..3303: note = Cas9 variant
  source 1..3303: mol_type = other RNA
atgaaatacaccataggcctcgatatcgggacaagctccgtaggctggggtgtcatcgacactgaaagaaaccgcatccaggacctcggggtcaggctattcgaaagcgcagaaaatcaaaaagacggcgaatcgctagccaaacccagaagagacgcccggagcatgcggcgccgcctagcgcgccgcggatcaagactagaacgagttaaaagcatcttcgaaaaagcgaagttcctaacgcgaggccagatgggcattacccacgcacgccccaacgatccctaccgcttacgagctgaagggctagaccgactattgagcaacgaagacctatttatcgcagtatatcacctggcaaagcgccgaggctacaaatccaaccggaaaaacgtactcgaaggagacggagaggacgtaagagagggtaaggctgtactcgacggcgtcgcccaaaacaagaaactaatggccttccgaggctaccgtacagtgggtgaaatgttcttcaaagacagcgttttcaccgaagcaaagagaaacaaagccgggtcctacaaacactgcgtccttagagagatgctagaggacgaactcggcaagatactccacgcccagcgctccctcggaaataccctagtgacagatagcttcatatcgaaactcctagaaaagaaaaccggtgtgttcgtataccaacgcccgttcgcatcaggcaaccaaatactaaaactcgtaggcccatgcactttcgaacccgaggagatcagagccgcaaaagcaacctacagcttccaatacttcaatgtcctccagagactcaacaacctgaccatcaaaaatacggacacaggaacagagcgaaaactcaccagtgaggaacgggcaaaaatgatcgccttcatattctctcacaaagacgtgcaatacgcccagatccgcctcgaactcaaactcagcgatgtcgatcgtttcaacatggtcaattacttcgtgcagcgaaaagaacttgaaacaaaaaccgccgaagaactgcgacgtgagatagaaaagaaaaccaaattccccagcctctccgactactacacaatacgaaaaaccgtaagcgagatagactctgccttctggatccaaatagaaaaacaacatgacgtaatagacgcaatcggcgagatattcacactttacaagacagacgaagacataatcgctcagttgaacaccagaatccccagcataccaagaccagttgtctccgcacttctgggcctgtcatttaccaagtttggccacctctcgcttaaagccctacgtaaaataataccgcacctcgaaaatggcgacacttacgacgtcgcctgcgcaaaggccgaccccaaatacaccgaccgcgcgaaaacccgcgcccgcaaattgcgccctctagacaaagaagaccactcgatcacaaaccctgttgccagacgagccatcgcgcaaacaatcaaggtcgtcaacgcaatcatcgacaaatacgacagccccagcgaagtacacatagaactcggacgggatttagcaaagaactttaaggaaagaatgaagatacagaaagagcaaaagcaaaaccaagagggcaacgaacgagccattgccaaaatccacgaactctacaaactcgaaaatccaagaggccaagatatcataaaattcagactgtggaacgaacagaatggccaatgtatgtacagcggagagcgaatcgacgagatacgcctcttcgataacggctacaccgaaatagaccacatcataccgttcagccgatccttcaacgacagctactccaacaaagtcctagtcctaaaaatgcgaaaccaagaaaagatgaacaaaacgccatacgaatacatgggcggcgacgccgacacctggcaacggttcgagaacctcgtaaacagcatgcacaatatcggaccccgcaagaaacaaaaccttctgctcaagaaatacgtggcagatgatctcacactacgaaccctcaacgacacaagattcatcgccagatacatgaaaaactacatagaaaacacgctactgttcacagagggcccacaaaaacaacgggtatacaccgtcaacggccaagcaacagcttacctgcgaaaacgatgggtcctccataaagaccgaaccgagaataaccgccaccacgcccaagatgcagtcgtcgttgcagtcgctaccccaagcctcgtgcaaggcataatgcgccacgcaaagatgggagaaatagtcgattacctccactcacaaaagttcgcaccaaacgttacagacatcgaaacgggcaaaccattcgagagcgccgacatccagtccgccaaagagagaataatagccaagcacgaacaccgattacgcataccagagccatgggaaggcttcagcgatgagctcgacgcgcgaatgggagatgacgtcgtagaaaaactttccctacgaaaatccaacatccacggatacaaaaccacctccgatttctcccaaatacatccaatcttcgtctcccgtatgccgaagaggaaaacgacaggacgggcacaccaagaaaccctcagatctccccgccgattcaaggagttccaagaatccgtagtgcgaacaccactttcatccatcaacctgaagaaactcgaggaaatgagcggcaaaaactcagataaactcctctacgatatactaagaaaacggctactcgcccacggagacgacccaaagaaagcattcaccgaaccggtacacaaaccccgcaaagacggcacccagggaccactggtgcgctcaataaaaatggtttccgaaggtcagcgcagtggcatactcgtgaacaatgaacaagcgctggtagaccaagacagcatgatcaggatcgacatcttcagcaaaccaaacaagaaaggcaaagacgaatactatatcatcccagtatacgcgtaccacttcgcccaaaaagaactgcccaacaaagtcataacagccaaagccgaagccgactggcgcaccatagatgacaccttcgcgttcgagttctcattataccccaacgacctggtaaaactaactaaaggcgacgacatacgcttcggttactactccggctgcaaccgagccctcgcagccatccatatactaccacacgaccaaaacatgccgctcgtcaacaacggcatcaaaaccctggacaagatagacaaatacgtcgtcgacatcctaggcgaataccacaaagtgggtaaagaaaccagacaacagatccagtga

SEQ ID NO: 7390 - RNA, 3303 nt, synthetic construct
  misc_feature 1..3303: note = Cas9 variant
  source 1..3303: mol_type = other RNA
atgggagcaaccattgtcacagacatatcgagaagcgcctttgccttcgatatagggacgaaaagcatcggaagcgcagtactcaggctagacgaccgaggagaaccaatcggcatcataaacgccgccgtgcgaatatacgcagacgggagagaaccaaaaagcggaacaagcctagcggaagggagacgcctcgcaagaggaatgagcaggagaagggaccgatacaaacgacgaagacgcacgttactcaacaccctcacagagttcgggctgatgccgcccactgacgaagcgagaaaagccctgctagcagaaacaaatgaccgaagattcggggcagttgccggaaacgtctacgcactccgcgcccgagcgctagacgaaaaactacccctccaccacttgggccgggccctgttccacctgaaccaaagacgtggatttaaatcaaaccgcaaaaccgacaaaagggacaacgaccaaggcaagatagccagcggcatatccaggctaggccaaaaattagacgaagctggagccagaaccctgggcgagttcctccacagacaacacagcgcaggcaagtgggtaagggtgcgcccatcaagggtaccatctaaagacgacaaggaagaagacgggtacgggttctacccagaacgcagctttctcgaaagggaatttgctgccatatggaaagctcaagcagcgttctaccccgaactactgacagaggagcggggtgaccacctacaccgagtgatgtttttccaacggccactaaagagacccaaagtgggaaaatgcagcttctacccggacgaggaccgactccccaaagcgcacccattgttccaagagttccgtctagtaaaagaactaaacgaactcgaagtcgtccacaggggagaccgacgagaaaaattaacactagaacaacgagataccctctttaaccagttacgcacacagcggtccagcgctttcacagcactgcgcaaaacacttaaagcacccaccggaacacgattcaacaaagaaagcgatgcaagagacaaattaaaaggagacgaagtcgccgccgaaatgtcacacaaagacaggttcggtcaggcctggataggaatgccattagccgaacgatgggcggtaatcgaaatgctactagacaccgaagaccccctagaagttaaagcatggctcgaggagcattacggattcgcagcagatagaatcgacgcaatagcagcagcaaaactgccaccgggatacggaagactgggcgagaccgcactacgagacatgctagacgaactgaagaacggcacggtcaaggatgactccggaagagacgtagttctaaccgaacgacaggcgatggacaacatatggaaggacaatccagcactacaacgagtagtagccgacgcccgggaactaccaccctaccaggaagtgctcggaaggaggattcccccgggaaccggaaaacccgaagacccatatgacgtacaaaaaggacggctcacaaaccccacagtacatatcggcctaaaccaactaaaacgagtagtcaacgcactggtacgacgccatggacggcccgaccagatagctctcgaactcgcaagggaactgaaactcaacgaagaacaaaaagccgaaaaggaccgggaaatagcccgaaacacaaaagcggcgcaagcacgaagcgaaaaactgagacaactcgacatagacgacaatggatataacagagtgctactaaaattatgggaagacctgaacctacgacaacccgagaacagggagtgcatatactgcggaaaagcaataggaatcggcacactcttcagcaaccaagtcgacatagaccacatcctcccgtggagcaaaacactagacgattcccaagccaaccgaatagtctgccacgtcgagtgtaacagacagaagggaaaccacgcacccgcagaagtgccacaatggcacgacagatacgatgacatacttgcaagagcagagagactaccaagaaacaaagcatggcgcttcgggcgagaagctatgaagaaattcaaagacgacgagagcttcctggcaagacaactgacagacacacaatacctaagccgcatggcccacgagtacgtcgcggccctctacccagacgaagaaccagatgaatggggagtcttcacccgccgcaaccatgtgagagtcatcccaggaagaatgacagagatgctccggagacaatggggactaaacgcgataatctccgatcacgaccaaaagaacagaaacgatcacagacaccacgcaatcgacgctatcgtcgtaggagtcacgacgcggaggctactacagcggatcgcaactgccgcgggcggacgtgaggcactagccttagaagaaacgataggcaagatcgaaccaccgtggccaggcttctacgacgatgtcaaagaagccatcgacaggatagtcgtctcacacaaacccgaccacgggtcactacctaaaccaggagaaccggcccgaacagcaggacaactacacaacgacaccgcatacgggtttaccggcgaagagaggaaaggcgtccccataatggtccaccgggtaccattcgccacactcacagagaaagacatcccctccatacgcgacagacaactcgcagaagcgctctacggagccatagcaggaatatcagggaaggccgaattagccgcagcactagcgagatttagtgcgagcggaccttacaagggaataaggcacgtgagagtagttgagccggtctctgtcatcgcaataaaagaccgcgacggtaccccatacaaaggatacaaaggagatgccaactaccgctacgacgtctgggaactgccgaacggcaaatggacgcacgaagtagtcagtatgttcgacgcccacagaccagactggcaaagcgagatccgcaacaaaaacccagccgcacgaaaggtgttaagcctacaccaaaatgacatggtcgcgtatgaacacccacaggacggctacacaatcggccgagtcgtgaaattcgggtcgggcggacagatggccctagcagggaaccgtgaaggaggcgcgctcaaatcaagagacgccgaccccgaagaccgattccggtacttctataaatccggaggagcaatgcgcgatgccagactccgacaggtaagagtagatgaaacagggagggtgttcgacccgggacctcaggaccgcgaatcccggaacgcgcgaaaacaatcagcagctggctga

SEQ ID NO: 7391 - RNA, 3306 nt, synthetic construct
  misc_feature 1..3306: note = Cas9 variant
  source 1..3306: mol_type = other RNA
atgaagacattgggactcgacctaggcaccaacagcctcggatgggcaatagtggagacccgggacgaacccacaaaatactctgaagggagcattgttgcaagcggagtccggatcttcagccaaagcgagatggcgggcagagacccacaaagcaaggcaagcctagcagtagcccggcgacaggcacgaggatcacggcgtaggagagacagatacctaaaacgaagacaacgcctcgtcgaccttctcgtagatctggggctaatgccagcagacaaggctgcacgcgcagaactggtcaaaaaccatggagacgggaagacaggggacctctcaagcagcgtatacgcactcagggcccgagctctagacgaagccctctcaccatacgaaatcggacgggcgatattccacctaaaccaacgacgaggattcaaaagtaaccgcaaagcagacagcaacgatccagagcagggagtaatatcagaagggatgagagcgctggacgagaaaatggctgaagcgggagcacgaacgataggagaatggctgcatatgcgaaggctacaaggattgccagtacgagcaagaatagcaccagacggcgaagggtacgccttttaccccagccgcggcgcgcttgagagggagttcgacagaatcatggcgagacaaaccctcttccacacagaccttctgacagacacagcaattagagaacttcgagaagtggtgttccaccaacgaccactaaggccagtaaagccaggaaaatgctcctacaacccattagaagaaaggctagcgaaagctcatccactattccagaagttccgactcctaaaagaacttaacgaactagagatagtaggagaagatcagaaacacataaaactaacccccgaacagcgaaatgcattagccttacagctacgcacctccctaaccaagcaaggcaaagtccccttcagtaagctcagaagcacgttaaaactaggcagagaagtaagattcaacaaggaaaccgacaaccgatccgacctagaaggagacgtcatatatttccgcatgagtaggccagaatgtttcggaaaccggtgggccgacctccccgtcgaaatgcaagcggcgataacagaaagactgcgaaccgagcctgactacaaaacactaatgaactggctcaaagcagaaacaggactagacgaagtacacgcgagggcggtagcggacacaccggtaccggacggattcggaagactgggccagagcgcgctaacagcactaatcgacgccctggagaacgaggtaggtgaaggcggcttcgtaataaccgaagcggaagcagcaaaacgagtctacggacgcaccaactcagaggctgacccagaccgcaaaggggtcgacgaactgcctaaatatcaagaggtactggcgaggcatatcccacctggcacgggagagccagacgacccatacgacgacttcatggggcgaatcacaaacccgacagtccacatagctctgaaccaactaagacgagttgtaaacgcactaatccgaacatacggcaaaccggacaggatcgcgatagaagtcggcagagacctgaagatgaacgaccgcgagagagacgaagtaaaccgaagaataggacgcaacacgaaagcagcaatagaaagaggagtcaaactcacagaaacattcagacagctagacaccggctacaaccgcctacgactagagctttgggaagacctgaaccaaaaaccggaaaaccgcgtatgcatctactgtgggaaagcgattgcgggccatatgttattcaacggggaaacagacatcgatcacatcctgccatactctaaaacactagacgactccaaagccaaccgcatcctctgctgcacatcatgcaacagagaaaagaaaaaccgaccgccgagtcgcgtgccacaatggcgatcacgctacggcgaaatcctagcaagagccacaacactccccaaaaacaaacaatggagattcgcggaagacgcaatgacaaggttcggggaagaagaaggatttcttgcacgccaactaactgacatgcaatacatctcaagacttgcattaacctacctagcccacctttacgactacgaggaagtagacctcgacggcatatacaaacgccacgcaagagtgagagctttaccgggcagaatgaccgagatgctaagaaggcaatggggactaaacgaacttctccacgaccataatctaatcggaggagacgtcgcaaagcctaaaaaccgcctcgaccacagacaccacgcaatagacgcaatcgtcatagcatgcacaagcagggccctcatccaacgcttggccaccgcatccgcagcagccgaagaaaggggagcggaaagagtggtcgaacggatagacccaccctggtccggcttccgagaagacgtcagggccgcggtcggagccatagtagtcagtcacaaaccggaccacggcacggtaggaagagaagggtatgcaaaaggcagaggacaaacagccggcaagctacacaacgacacagcctacgggcacacaggagaaaaagacgcaagcggcaacgacatagtcgtaagaagaatcgcggtaaccgatatcagatcacccgcagacataagaaaaataagaacaaacgcccacggccactcagaactacgggacaggctatacgaagcaacccgcggcctggagggaaaagcgttcgagcaggcagtcttagacttcgtaaaaggcgatgccaaattccgagggatacgccacgtaagaatcacggaggtagcgaaccccgtatggataacacacggagatggcagacacaagaaaggataccttcccggcggaaacgaccgattcgacgtttgggaactggcggacggccgatgggacgcggaagtagtgaccacattcgacgcgcacaggcccggattcgtaccgagaatgcgactggaaaaccacaacgcacgcaaaataatgagcctcaaaaagggggacatgatagcgtacaacgaccccgtgagtggacaacgaataatagccatcgttagaaaattcgaccagaggaacaaacaactatacctagacccccacaacgaagccgggaatctggaccggagagaaaaagagaaaacctataaaccactcagacccatgccaaacccactcaagaagtaccgaccccggcaggtcaggatcgacgagatcggtcaggtgttcgacccaggaccgtggtgggagcgacaagacggttga

SEQ ID NO: 7392 - RNA, 3306 nt, synthetic construct
  misc_feature 1..3306: note = Cas9 variant
  source 1..3306: mol_type = other RNA
atggaacaaacctcattagacctatcacaggcaatgaaaaaggtggcccaaccccaaaaaccctaccgcctgggcgtcgacgtaggtgtggcgtctataggagcagcagccgtcacagacacggaaattctagggatacacgtccgtaccttcgaaaaaggggaaatcaatggaaagtcaggacgcaaacccctcaacgccgactacaggagacagaaaggacaacgcaaacgtcttcgacgcaagaaaaacagactactttctctacgacggctattccgacgtgtcggaatgatcgaatccgctgccatagaagcgttccctatctcctcgaccagcccatggcaactcaggaccgagggtctagaccgccgactcacaaacgaggaatgggcccaagtcctataccacatagcgaaacaccgaggcttccaaagcaaccgaagagtggatatggacgaggccacaaaactcagcgacgcagccggagactcccccgaaacaacgaccaacaccgaaagtgacagcgatactaagaaaatgctggcgggggtggccgacaacaaacgtctcctcgcagaaaaaggctatcgtacgataggagaagcggtagcacgcgaccccaaattctcccaccggatacgaaacaaagaggagagctactcccacaccattggccgagacgaaatcaacgcggaacttaactgcctcttccaagcccaaaaccactacggcaacccacacgccaccgaagaactaagtgaacaaatcatagacctaatcaactggaggcggaaaaccgtgaccggcgacgacataaagcggatggtaggccgctgcacactagaacccaaggaatacagagccgcaatccactccgtatctgccgaggagttccggtggctctccacgctcagccgcctacgcatagtaacccagggagaatcaagaccattaacaaaatgcgaatgggacaaagtagtcgacctcccctggcgacaagaagcaatcacctacacgtcaatacgaaacgctatcggacttcgacacgatatcaggtcacgcttcaacattcgatacgaaaccggcggaaagaaaaccaagacggacaccaaaaacgagacaaccaaaggccaaagcgcggacgcggtcacctccgaagtcaaaacagccgaaaaggaaacagccttcaaggcaaaaggataccatattctgcggaaagcatacaaggccttcggctacgacgaacaatgggacagagaccgcttcaacactgaactcctcgacaccctcgcaacggcagtcaccttctacaaagacgactccgaaatacaagctcacctagagaccaacgacacaccagaatacgcaatccaaatagcactacgactacccaccctcacaaagtttagtaagctaagcaacaaagcaatacttaaaatactcccccacatgcgcgaacggcaatcatactcaaatgcctgccttctcgcgggctacaaaaatcaccacaagcaatatgacgatacaccccaaaatggcaaaatccctcggagcgcgatagaacacatcaagaacacagtcgtgtacaggagcctaaaccaggcccgacgcgtcataaacgccatggttaaagagtacggcgccccacaggaagtccacattgaattagcccgggacatggagaaatccgcgaaaaagaaagacgaaatcgacctctggatgaagaaacgcaaaaagaaaaacgacgaactcagagaacgattcggcaaaaacctcagccgcgacgaactcctaaaatacaaactctacgaggaacagaatggacaatgcgcatatagtctccaaccaattcaactcggccggctcctggagcccaactacgtagaagtagaccacgccctaccgcgcagcaggagtatggacaattcctacaacaataaagtgctcgtactaaccaaacagaaccgagacaaaggcgaccgtaccccattcgagtacttcggcgaagaccaggaatcagtagattggaaacgcttcaccaactgggtcgagtcgaacccccaaatgccccaagccaaacgacgaaaactcctaaccaaatccctccaaaaaggcatattggacaacttcagcgcacgcaatcttagcgatacacggtacatcgctcgcgaattgaaaacccttatcgagcactacatactcaacaccccagaacgcgagaaaacaaaatacgaacgatgcgtcgtaatcagcggaaaactcaccgcccaaatgcgtcaactgtgggggataagcaaggcaagagacgtgagtgaccgacatcacggatccgacgccgcggtcatcgcttgcatcactcccagcatggtacgacgaatcacacgctacctacaactccaagaaaggagagcaatgcccagcgcccccgggaagggtgacgaacaccccgcagtcgtcgcacgcgcgatcccccacgccccagtcccctggcccacattcgaacacgacctcgaagcagccctagaaaaagtcctcgtctcacgaccacaatcccggaaatggtccggccccatccacgcagacaccatctacggcgaacacaaagaccaggaaacgaacacggtagccccaacacaacgcatcaagctaacccaactaaccaagtcaaactacaaaaacatagtcggatacgacgaagaaaggaacaaggacttcatagaccaaatcgaggaacggcttgaatgccataacttcaacggaaaacaagcctttggaacatcacagtcccctatctatcgaataaagaaaaacggagaactaggacccgaagtcaagaaagtaaccatcaaactcccaatcaaaaactcggtcttccgcatacgccgcggctacgtcaaaaacgccaaaaactcaaccatatacataaacatatatcaaaacacgaaaaccgggaaattcgagatgcacccagtctacgcaaaagacttaacatcgagtgcgaacgccagtaagagcttcgaatactcccccgacctacagctagtagacacaatccgacggggagactacatagagatcacccgcagaaacggcgaagtcatatcaggatactacgctacccacaacataagcacgtcagttctcgagctccaaccccatgacacaacagactcccggaacaaccgaacacccgccataaaaacaagcctcaacatcgagcgattccacatcgatatcctcggccgcaaacgcagggtggtaagacgagccaaaaacggactagcagacgacagagacaaatga

SEQ ID NO: 7393 - RNA, 3309 nt, synthetic construct
  misc_feature 1..3309: note = Cas9 variant
  source 1..3309: mol_type = other RNA
atgggctaccgcatcggcctggacatcggcatcaccagcgtgggatacgccatcctcaagaccgacgagaagggctccccctacaagatcgagcacctgacgagcgtcatattcccgatcgccgagaacccaaaggacgggaagtccctcgcgatgccccggcgcgagcagcggggcgcccgcaggcgcaaccggcgcaccaagttccggaaacaccgcaccaagatgctgttcgtgcggagcgagctcctgaccatcaagcagattgaggccatatactccgagaagcagaaactcagctccatctacgagctgcgcactaaggccctgaacgagcggctcaccaacgaggagctgttccgcatcctgtacttcttcagcggccaccgggggttcaagtccaaccgcaagagcgagctcaccgagaaggacatgggccccgtgctgaccgccatcaaggacatcgaggagaagctggcggacgggacgtaccggaccctcggcgagtacatggaattagatgagaagtaccaggagcacaagcgcaacaaggacgggatagaccggtacctgggcaccgccaagcggtccctcatcgaggacgagatcaagcagatcatcatcgcccagcagcagttcggcaacaccaagctgacgagcgggttccaggtcgccttcatcggtgacgaggagcagaccgggatcttcaacgaccagcgggagttcgaggacggcccgggcaagcagtccccctacgcggggaaccagatcgagaagatgatcggcgcctgcaccttcgaggagaacgagaagcgcgctcccaaggccagctacaccttccaatacttcgacttcctgtgcaagctcaacaacctgaagtaccgcgagacgatcggcggggagtatcggttcctgtccttagagcagaagaacgtgctgaaggagaaagtgctgaccacccagaagataaccttcagcggcgtcaagaagctccttgacctgcccgagcacgcccagttcaacctcgtgaactacggcacgaaatccaccgtgaaggagaccgagactaagagcgtcttctacgcgatgatctcctaccacaagctgaagaaggccatcccggcgcccatcttttcaaacctgagcacggccgagttggacgagatcggccgcatcctgaccctgtactccagcgacaaggggcggaagaacgagttctactctcgcctcgccatccccgaggaggtggtggaggcgctactgcccatcaacttctccaagttcggcaacctctccctgaaggccatgcggaagatcatcccgtacctggagatggggctcgtctacagcgaggccgcaacccaggccggctacgacttccgccacaagaagattgaccaggcgtacatccacgaaaacgtgaccaaccccgtggtcaagcgggccgcctcccagacgataaagatcgtgaacaacatcatccgcaagtacggggagcccgacggcatcaacatcgagttagcccgggagctgagcaagaacttctccgagcgcaagaagaccgtgaagtaccaggaggagaaccgcgcccgcaacgagcggatcgcggacaagctcagagagtgcgagctgcccgtcaacggtgccaacatcacccggctgaagctgttcgaggagcagggggagttcgacccgtacaccggcctcaagatccccttcgaccgcgccttcagcgaggagtacgaggtggaccacataatcccctactccaagacgctggacgacagctacgggaacaagatcctcgtgagcgccaaggcgaaccaggagaagggcaaccggatccccatggagtacctccaggggaagccggagcgcatcaagaagctggagagcatcaccgccaccatcaagaaccccaagaagcgggagaagctgctcaagcagcagctgaccaaggaggacgtcgacggctggaaaacgagaaacttgaacgacacccgctacatctcgagcctcctgcacgactacttcaaccagaacatctccttcgccaagctggagagcgagaagaagaagagggtgattgccgtgaacggcgccatcacctccaagttgagggcgcggtgggggttcaacaagatccgcgagaacggcgacgagcaccacgccctggacgccctgatcgtcgcctgcgtgaccgacaagtacatcaaggagatcaccagcttcagcaagcggaaggaggtccgcttcaacgagaacctctggaagcgggagaagacgccccaggagatcgagcaggaggtggtgcacttcaagaaggactacgaccgcatcttcaaccaggccttccccctgccgtggaccaacttccgggaggaggtctcctgccgcatgagcgagaaccccgcggagctgatgaagaaccacacctgggagacctacacggacgacgagatcgccgcgctcaggcccatcttcatcgtgcgcatgcccaacatgaagacctccggtcccgcccaccaggagaccatccggagcggcaagctggaggagaagggcttgaacatcagtcgcgtgagcatcgagaagctcaagctggacaaggagggcaccatcaagtcaggcaacgcccagttctacaaggacagcgggaacggctggcagctgttgcacgataagctgaaagtcgcgctggagaagcacgacggggacggctccaaggccttccccgacggcgtcttcaagtaccagtacctcgacaaggagcacacggtgaggaaggtccgcttagtggccaagagcactctgcagacctccctcaacgagaagaagtccgtggccgacaacgggagcatgatccggatcgacgtcttccgcaacgagcagggaaagtaccagttcgtgcccatctacgcgaaggaccgcgtggccaaaaagctgccgaaccaggccgttgccgtggggaagatcgccaaggagtggcccctgatcgaggagagcgacttcaagttctccctctacagcaacgacctgatccgcgtgaagcacaagaagggcgtcaagcacgtgtccaaggacgggaacaaggaggagaagtccaagaccgacttcttcggctactacacgggcgcggacatcgccaccgccagcatcagcgggatcagccccaacaacttcttcgagttccggtccatgggcctggccaccctcatcagcatcgaaaagtacaaggtggactacttcgggaactaccaccaggtcaacgagaaggtgcgccagaaattccccaagaaccgcatgtga

SEQ ID NO: 7394 - RNA, 3312 nt, synthetic construct; identical to SEQ ID NO: 1594
  misc_feature 1..3312: note = Cas9 variant
  source 1..3312: mol_type = other RNA

SEQ ID NO: 7395 - RNA, 3315 nt, synthetic construct; identical to SEQ ID NO: 1595
  misc_feature 1..3315: note = Cas9 variant
  source 1..3315: mol_type = other RNA

SEQ ID NO: 7396 - RNA, 3315 nt, synthetic construct
  misc_feature 1..3315: note = Cas9 variant
  source 1..3315: mol_type = other RNA
atgaaccactacgtgctgggcctcgacatcgggatcaccagcgtcggctacggagtgatcgaccttgacaactaccagttcgtggactacggcgtacgcctgttcaaggaggggaccgccgaggacaacgtgaaccggcgcacgaagcggggcagtcgccggttaaagcgcaggaggcagacccggctggacgacatgaaggagctgctccaaaaggagaagatcatgagcgagacctaccactccagctacgacccctacgacatgcgcatcaaaggcctgtcccagaagctgagcaacgacgagctgacttgcgccatcctgcacatcacgaagtgccgggggaccaccctggaggcgctcgactccgccgacgaggacagcgaaggcaccaagtccatcctgagcaagaacgaccaggacctgaagaagtaccactacgtgtgcctcgtccagaaggagcgcctgaagcagtccgggaagatccggggcacggagaacaacttcaagacagacgactacatcaaggagctggatgagatcctcagccaccaggacctgtccgaggacctgtgtgaaaagatccgcaccatcgtgagccgccgccggcagtactacgaggggccgggctccgagaagtcccccacaccctacggccgctggatcgcccagggggtggcccccatcgacctcatcgagaagatgcggggcaagtgcagcgtcttcccggaccagctgcgcgccgcgaagaacagctacacggccgagctgttcaacctcctgaacgacctgaacaacctcgagtgcgagggggagaagctgacgacctcccagaaacaggacgtgatcgacttcgtgaacgagaagggcggcatcacccccaagcagctggccaagctgctgaacgtcgacctcaaccagatcaagggattccggatcgacaagaacgacaagcccctcctgacggagttcaagggctacaaggccttcaagaaaatcttcgacaccaacaactgtgacctgtacaagaaggacctctccatcctggacgggttagcggagattgtgaccggcaagaaggggatcgaggagcgcaagcaggccatccagcaggcctaccccgagatcgacgaggccatcgtggagcagtgcgccgtcatgaagggcatgacccagtaccacagcctctccctgaaggcgatgcacctgatcaaccaggagatgctccagagcccgcgcaaccagatgcaggtcctgcacgagtcccacgtgttcgacaagaaccgggtgagccacaaaggccagaagtacatcgaagccgacgacgaggccatcctgtcccccgtggtgaagcgcgcccagcgggagacgttcaaggtcgtgaacgccctacgcgagaagtatggggagttcgagagcatcgtggtcgagaccacccgggacagaaactcccaggagcagaagaagcggctgaacgacagccagaagtactacgagcaggagaaccgcaaggtggacgagctgctctcccacgagggctacgaccccagcaaaatcaacgggaagactaagctgaaggtccggctgtacctgcagcaggagggcaagacggcgtacaccaacgcccccatcgacctcaacctgctgatcaaggacgccactgcctacgaggtggaccacatcatcccgctctccataagcctggacgactccatcaacaacaaggccctgatcaaccgcaccgagaaccagaacaagagcaacatgacgcccatctacgcgatcctccgggggaagctgaacatttccctggatacctacaagaccgtggtcaagaacaaccgcaactacaccggcaagaagcggagctacctcctgtacgacaaggacatcacgaagttcagtaacatgcaggagttcatcgccaggaacctggtggacaccagctacgcatgccgggtggtcatgtccaccctcagcgactacttcaaggacaacgagatcagcacccacgtgcacacggtgcgcggccgggttaccaacatgttccgcaaccggatcaacatgcagaaggagcgcgagaaggactacctgcaccacgccgtggacgccctgatcgtggcgagtatcaagaaactcaacctgctgaacacctacctcctgaagtacaacttcaacgacctgtacaacgaggagaccggggaggtcttcgccgtgggcgacgaccagcaggtcctcgaccccaagtacatccgatttatcacccagctgaagacgatctacgacgagagcaacatgtactacaacgggctgatcgagcggaacgtgatgcagttcccgcccatcaagatctcccacaagatcgacaccaagcccaaccgccaaatcagcgacgagaccatctattccacccggacggtcggcaacgaggagtacgtggtcaagaagtacagcgacatctacgaccccaagttcacccagctcaccgacgacatcatcaacgaccgccccctggacaggtggctgatgtaccgcaacgacaaccagaccttcaagatcatccagtccatcattctcgaccacttccatatcttcaaggacgacgagaagcactacagctgcacgaagaagaaggggcagatccagtacgccctgaagggcaagaacccgctgtacctctacaagcaggagcacggtaaggtgcggaagtacgccaagaaggggaacggccccgagatcaccatgatgaagtacttcgacgggaagctgggcaacaacatcgatatctccaaccactaccacgtgcacaacaaaaaggtagtgctgctccagatcagcccctaccgcaccgacttctatgtgtcacccgagggcaagtacaagatgctgaccgtccggtatgcgaacgtgttctacaaggagagcaagaagaagtacgtgatagacgagaagtggtacgcctccgagaagaagcgcaagaacatcacggacgacgacatcttcgtctgcagcctgcaccacgacgaactcatcgggatccagaagaaggacggcgccaagtacgtgtacgacctgtccaccgaggacggtggcaagccgcggctgtaccacggggagatggagatcctcaagttcaccgccaccaataacgacagcaagaacatcatcgaggtgaagcccatctacacgtattgcaagaaacagctgatgatctccatcggccccatcaccaagctggccaagtacgcgaccgacgtcctcggcaacgtgtacgaggtgaagaagaacatcatcgaccacctgagccacctgtga

SEQ ID NO: 7397 - RNA, 3318 nt, synthetic construct
  misc_feature 1..3318: note = Cas9 variant
  source 1..3318: mol_type = other RNA
atgggcatccgcatcgggctggacatcgggatcgccagcgtggggtgggccgtcgtggacgacgactacaacatcatcgagtccggcgcgaacatcttcaacgaggccaaggcagccagcaacgtggaccggcgcacgtttcgtcagaccaagagactcctgcggcgccagaagacgcggctgcgcgactttgacatcctctggatcaacgccgggctggacatccccaaggagaaggtcaacaagcagctgcagttccgggtgcagggcatgaccatggagctctccgagaacgaactgtacgcggcgctgaagaacatgctcaaacaccgcggcatcagctacctggaggacgccctggacgaggagcagtccggcaagagcacctacgagaaggggctccaggtgaaccagaaggcccttaagtgcgacaagatgccgtgcgaaatccagtacgagcggctgatgaagtacgggtcctaccgcggccacatcgaggtcaaggacgagagcggggaggagatgatcctctccaacatcttcaccctggacgcgtactgcaaggaggccaagaagattctggagtgccagaagcagtaccacagcttcatcacggaggccttcgaggacgactacctcgccctgctgcggcgcaagcggaagtactacgagggccccgggaacgagcagtcccgcaccgactacgggaagtacaccaccaagctcaaccccgagacgggcgagtacgtgaccgaggagaacatcttcgagaagctgatcgggaagtgcagcgtgtaccccaaggaaatgcgggcctccgcggccagctacaccgcccagatctacaacatgctgaacgacctcaacaacctgaccatcaacggccgcaaactggagtacgaggagaagaagtccatcgtcgaggaggtgcagaaggccagctccgtgaacatgctcaagatcatcaagaaggtcatcaacgaggacatcacgaccatcgagggcgcccggaaggacaagaacgacaaggagatcttccacaagatggagacttacaacaaaatgcgccactacttcgagaagaacggactggagttcaagaaaatcagcaccgacgacctggacgagatcggcaacatcctcacgctgaacaccgagaaggaggcgatcctggaggccttcaacaagtcccagctcgagctgagccaggaggagaaggaggccttcatcgagatccggaagaagaacgggagcctgttcaacaagtggcactccttctcactcaagatcatgaaggagctgatcccggagctgtacctccagtccaagaaccagatgcagctgctgaccgacatgggcgtgttcaagaagaagaccgagatcttccagaactacgacaagatccccacggacgtgatcatcgaggacatctacaaccccgtcgtgaagcgcagcatccgtatcaccgtgaagatcgtcaacgctctcatcaagaagtacgggtatccccgggaggtggtgatcgagatgccgagggaccggaactccgacgaagagaagaagcgcatccaggacgagcagaagaagaatgataccgagctgaagaagatcatcgagaaggtcgagagcgagtacggcatcaagatcaccgacacgcacttccggaaccacaagaacctgcgcatgaagctccggctgtggcacgagcaggacggccgctgcctgtactccgggaaggtgatcgatatcagcgagctcctgaacgactgctccaagttcgagatcgaccacgtgatccccaagagcatctccttcgacgacagccggtccaacaaggtcctggtatacagcaccgagaaccagaagaagaccaaccagacgccctaccagtacctggagggaaacgggaaggagtggtccttcgacgagtacatgaaccaggtcatcgagctcaaggaccgcaagctgatcagcaaggccaagatgaacaagctcctgtttcgggaggacatcacgaagatcgaggtgctgaagggcttcatcgcgcgcaacataaacgacacacggtacgcctcccgcgtggtcctgaacagcttccagaagtacttcgagtccaagcagagcgacaccaaggtgaaggttatccgggggagcttcacccaccagatgcgcaagaagctccagctgtccaagaatcgggacgagagctacgcccaccacgccgtcgacgccatgctgatatgctactcccagatgggctacgaggcataccgccagctccaggaggacctgatcgaccccgacagcgagaagatccgggacctgggcctctggaaggagacgatcaccgaggctaagtacgacgaggtgctgtacaccgccaagtggctggagaaccgcgggaagatccaggaggccgagaagaaggtgaagttctggcacaaggtcgactccaaggcgaaccgcgccctctgcaaccagaccatccggggcacgagggtgatcgacgggagcatccagaagatcaacaagatcaacatctactccgtggacggctacaagaccttcaagaacatgatccagaaggggaaggagaaggacttcctgatgtaccggaacgaccgccggagctgggacgacctgatgaaggtctaccgcgagtactccgacgccaagaacgccttcgccgcgtaccaggaggagactggcgactacgtgcggaagtacgccaagaagcacaatggcagcaagatcaccaacctcaagtactgcgccaaggagctggggtcctgcatcgacatcagccacaagtacggcctggagaaggactcccgcaaggtgatcctcgagagcctgtccccgtaccggagcgacgtctactacaacgccggcctgaagcaatactacatcgtgggcatcaagaactccgacctatgcttcctgaagggcgagtacttcatcgacagcaagcgctacctgcagatcctccgggaggagggggtgctgaccgagcagcacacgctgaacgacttagccgcaatcggcaccgagttccagttcagcctgtacgagaacgactacctggagtacgagaagaacggggagatcaagaccgagcgcttcctctcccggaccaagcccaagcagaagaactacatcgagaccaagagcatcgacgcccctaagatcaagaacaagaagcagaacctggtcggcctggccaagtccaagtctatcaagaagatccgcgtcgacatcctcgggaaccgttactacgcttccaaagagaagttcagcctgatggtcgacaagttctga

SEQ ID NO: 7398 - RNA, 3318 nt, synthetic construct
  misc_feature 1..3318: note = Cas9 variant
  source 1..3318: mol_type = other RNA
atggacatggcctggcgcctcggacttgacctcggaacgaactcactcggatgggcggccctatcgctagacgcagcgggggctccagacgcaatcctagcagcgggtagccgcatcttcggagacggacgagacccccagagcgggacatctctcgcagtcgatcgtcgggccgcgcgagcagcacgacgcaggcgcgaccgattcaaacagcgtcagcgcgcactactgaaacatctcgaggccgacggcctattcccagcagacccagaggtacagcaggcgctagcagcccttgacccatacgcgttaagagcacgagccttagatgaggcacttagcctacatgaaatcggcagagccctctttcacctcaaccagagacggggattccaaagcaacagaaaagccgacaggggcaaggacgaggacgccggaaagatcgccataggagtcgaccgactaaaagatgcgatcgccgccgccggtgcaaggacctttggcgagttcctgcgccaacgacgagcaggcgccaccggtgaaaaccagataccatccgtccgcacacgcctacgcgcagagaccggcgagggcgcaaagggaagcggttacgacttctatccaagccgagccctcctaaaggacgaatttgacgcgatatggcacgcacaagcagaacaccacccaaaagtactcacagacgaagcctaccacaggttacacgagattgtattccgccaacgtccgctcagagcaccaaaagtaggggcgtgcacgcttgtaccaggggaggcaagactacccaaggcccaccccttgttccagcgcaggagacttctagaagaactcaacgccctcatgatagtacgcgcaggcgccgtagcggaaagactaaccccagagcaacgcgacctcctcctccttaaactcaaggacaagggaaaagtcacattcaaatcattacgagagaaagtgctgaaactcgacggagacgcaagattcaataaagaatccgagcatagaaccgaactcaaaggagacgaggttgcagcggaaatgggcggcaaaacaagatttgggagtctatggccccatctcagcaccgaacaacagtggaccgttatagaacgacaacaggcactcgaaagcgacgcagacgaagcagccttccgaacatggctcgtggaaacccacaaactcacagctgaacaagcacgcgcggtagccggcgcccgactaccggcaggacacggcaggtttggcctaacagcgacagcagcacttcttgccgcgctccgggacggacgcacacccgaaggacggggcccaaacgcaccagcaaccgaagcagggagagtggtagtctacagcgaagcggccgcgatcgcaggatatcaccacagcgaccaccgatccggagaagtattcacagatgcgaaaggaagaccagcactaccatactacggcgtccccctagacaggcacatcgtacctggaacagccgacccggacgaacccgacgaagcggctcggataggacgtttgaccaaccccacggtccatatagcactaaaccaattacgaagagtggtaaacaggctaatacgcgtgtacggcccgccggcagaagtcgcgctagaactagcaagggaactcaagctgtcggaagacgaaaagaaagaacgcaacagagaaaactcaaggaaccgtttagacgcagagaaaagatcaagcaaactagccgagctggggcagagagataatggcggaaaccgcgcccttctaaaattgtgggaagaactaaaccccgaaaacatactagaccgccgatgcatatactctggaagacaaatcagcatcggtatgatattttcgggcgcagcggaagtcgaccacatactaccattcgacgcaacgctagacgactcgaatgcaaacaaaatcctgtgcctaagagaagccaaccgcgacaaacgcaaaagatcacccttcgaggcctggggcgggactccgcaatgggaagaaatagcagaaagggccagtagattgccaaggaacaaacgatggaggttcgaaccggacgcaatggaacgattcgccgaagaaggagggttccttgcgagacacctcgtcgacacacaatacctcggaagaatcgctcacgactacctaagatgtctatacccggataagggcgacggctcgagccacgtctgggtctccccaggacgactaaccgagatggtgcgcaggaagctaggcctaaacggcctcctaggcgaccacaacctcggcgctgaacaacccaaaaaccgcaaagaccaccgacaccatgcaattgacgccgtagtcacagccattctagaccgaagtatgctgcagcgcatacagcgagcatcaggagagggagccagtgacgcggaactcctgagaatcatagtcccggaaccatggacaggattccgagacgacctacaacgggccgtcgaccgcatcgttgtggcgcaccgggcggaccacggcaccgtagcaaaggcagcaacaagagggagagaccaaaccgccgcaagactccacaacgacaccgcatatggcttcacaggcgaagcagacgcgaagggcacaccaatagtcgtgcaccgcgcacccctcggggccctaaagaaacccgagcacatagaccaagtcagggacccactgctaagagcggccctccacgacttcacggccggcctatcaggcaaaccctttgaagaccgtatagccgcgttcccccgcctaggtccgttggactaccggggcatcagacgagtaagagtcgtagagcccctacaagtcatcccaatacgcgacgccgccggacgggcctacaaaggatacaaaggcgatagcaactaccgatatgacgtatgggaactgcccgacggcaagtgggaacaacgagtcctacagatgtactacgcccaccaaagcggggaaccaccaagaccccacccagcagcgcgaaaagtcctgtccctgcacagggatgacgtactagccatagaacgaggcgaaggcgggcgggaactggtaagagtagtcaaattctccaccaatgaatttaccttagcaccactaaacgaaggtggggcgctgaaaagccgtcacgcagacaaaggagatcccttcaggtacctatacccatcacccagcacactaaaggcatggagagccagagaagtacgcgtcgacgaactaggacgagtactagacccaggattcccggcaaggaagcggcgccgcgtcacaagaccagggcgagcagacgcagactga

SEQ ID NO: 7399 - RNA, 3321 nt, synthetic construct
  misc_feature 1..3321: note = Cas9 variant
  source 1..3321: mol_type = other RNA
atgcagtacatcgtggcaatcgacatcggcgtcgccagcgtggggtacgcggtgatcgacaagacctccgagaccgtcatcgaggccggcagcaacatcttccccgaggcctccgccacggacaaccaggagcgccgggggatgcgccaggcccggcgcctgaagcggcgcgagcggacccgcctcgacgacttcaccaagctgtgggaataccacggcctggcgatcccccaggtgaagaagaacgacatcgtggggctcaaggtcaaggccctgtacgagagcatctccttggacgaggtgtacctcatcctgtactcatacctgaagcaccggggcatctcctacctcgaggatgtggaggacagctccgtcagcggatccaccgcctacgccaacgggctgaagctgaacgcgaaggagttagagaagaacttcccgtgcgagatccagaagtaccgcctggagaacatcggcaaataccgggggcagatccagatcgaggacgaccagggcgagaagctggacctcagcaacgtgttcacgataggggcctacaccaaggagatacagcagatactggacacccagaagaagtaccacgcagagatcgaggacgagttctgcgagaagtacctgaagatcttcacccgcaagcgtaagtactacgagggccccggcaacgagaagtcccgcacggactacgggaagtacaccacccggctcaaggagaacggcgaatacatcaccgagaagaacatcttcgagaagctgatcgggaagtgcagcgtgtacaaggatgagctgcgcgccgcctccgcgagctacacggcccaggagttcaacctcctgaacgacctgaacaacctcaccgtcaacggccggaagctggaagagaacgagaagcacctgatagtggacaaggtgaagacctccaacaccatcaacatgcgcaagatcatcgccgacgccatgggcgagaagatcgaggagttctacggcgcccggatcgacaagagtgagaaggagatcttccacaagttcgaggtctacaacaagatgcgcaaggcgctcgccgccatccacgtgaacatcgaggagttctcccgggacgacctggacgagataggctacatcctgacgatcaacacagacaaggaggccatgatggaggcctttgacaacagccgcctcgagctgcccggggagatcaagaactgcctgatctccctccgcaagaccaacggcaccctgtactccaagtggcatagcttctccctgaagatcatgaacgagctcatcccggagatgtaccggcagcccaaggaacagatgacgctgctgaccgagatgggggtgatgaagggccagacggacgagttcgaaaagaacaagtacatccccgtcgacgtggcgagcgaggacatctttaaccccgtggtccgccggtccgtgcgcatcagcttcaagatcctcaacgccctaatgaagaagtacggcactctggacgaggtggtcatcgagatgccgcgggaccgcaactccgacgagcagaagaagtgggagaaggagacacagaagaagaacgagaaggagcaggagtacatcgagaacaagctcgccaccgtgtacgacatccggctgagctccgccgacttcagctcccagaagcagctgaacctcaagctgaagctgtggaacgagcaggacgggaagtgcctctacagcggcaagatcatcgagcccgaggacctgatcaagcactccgagctgttcgagatcgaccacatcatcccccgcagcatctctttcgacgactcgcggtccaacaaggtgctggtgtaccgcaccgagaaccagaacaaggggaaccagaccccctactactacttaacgcacacaaacagcaagtggtccttcgagcagtacaaggccctggtgatggacctgagcaagaagaaggagtacggcctcagcaagaagaaggtccggaacctgctgtactccgaggacatcaccaaggcggacgtgctccgcgggttcatcaaccggaacatcaatgacaccagctacgcagcccgcgtggtcctgaacacggtgcagggctactttcgggccaaggagatgggcaccaaggtcaaggtcatccgcgggtcctacacccaccagatgcgggtgaacatgaagctggacaaggaccgcgagaagtcctacgcgcaccacgccgtggacgccatgctcatcgccttcagccagctggggtacgaggcctaccggaagctgcagggagagttcatagacttcgagaccggcgagatcctcaacagcgagaagtggaaggatcagatgtccgacgaggtctacaaacagtacctgtaccgcaagaagtggagcaacatccgcaacgagatcacgcgggcggaaaagaacgtgaagtactggtactacgtggaccacaagtccaaccgtgggctgtgcaaccagaagatccggggcacccgcgtctatgacggcaagatctacaaaatcaacaagctcgacatccggaagaaggagggtgcggcccttttcaagaagctggccttcagcgagaaggagtccgaccgcgagaagctcctggtgtacaagaacgacaagaagacctacgaagacctggtgaggatcatgcaggactatagcgactccaagaacccgttcgtccagtacgagaaggagaccggcgactacgtgcgcaaatacgcgaagaagcacaacgggccccgaatcgacaagctcaagtacatcgacggcgaggtgggcagctgcatcgacatctcccacaagtacgggtacgagaagggcagccgcaaggtcgtgctggagtccctggtgccctaccggatggacgtctactacaagaaggaggagcagacctactacctcgtggggatcaagcagagcgacgtgaagtgccagaagggcgagtacgtcatagacgaggacgcttatgctatcaacctggtgaaggagaagatgatccagcaggggcagaagcgcagcgacctggagtccctcggcttcgagtttcagctgagcttctacaagaacgacatcatcgagtacgagaaggacggcaagatcgtgcgggagcgcttcctgtcccggacaatgcccaaggtcaagaactacatcgagaccaagccgatcgaccgcgccaagtacgagtggcacgaccggaagctcgtggggctgggcaagaccaagcgcatccggaagtaccgcatggacatcctggggaactactacctctgcaacaaggaggagttcagcaagtactgctga

SEQ ID NO: 7400 - RNA, 3324 nt, synthetic construct; identical to SEQ ID NO: 1600
  misc_feature 1..3324: note = Cas9 variant
  source 1..3324: mol_type = other RNA

SEQ ID NO: 7401 - RNA, 3324 nt, synthetic construct
  misc_feature 1..3324: note = Cas9 variant
  source 1..3324: mol_type = other RNA
atgggctacaccctggggctcgacatcggcatcgccagcgtggggttcggcctgatagacaacgtcgacgggaagatcctggagtccggcgtgcgcctcttcagctccgctgaccccgacaacaaccagaccagacgctcaagtcggcaggcgcgccggctgaaccgccggaaggtgcaccgcctggagcgggtcgcccacctcctggaggaggccggcttcgagaagggggaggtgctggcccccactccctaccatctccgcgtcaagggcctgaccgagaagctgagcaagccagaggtctacgccgcactctacaacctgatgaagcaccgggggatctcctacctagaggacgtggagctagacgaagccgacagctccagcgtgtcccagaacgtcgagctgctgaaggagtactacccctgcgagatccagctcgagcgctacgaggagtacggccagatccgggggattatcgagacgtacaacaaggatggcgagaaggagagcctggtgaacatcttcccgaccggcgcctacaagaaggaggccgaagcgatcatcctgaagcaggggcagttctaccccgagctcgacaaggtgttcctggagaagttcaccgagatcctgaccgtcaagcgcccctactacgtgggccccgggaacaagaagtcccggaccgactacggcatctaccgcgagaacggcgagaccctggagaacctgttcgacatcctgattggtaagtgcacgatctacccgcaggaggcccgggccgccaagttcagctacaccgcacagctgttcgacttcctgaacgacatgaacaacatctccatcgccggcgagaagctgaccgaggtgcagaagcgcgagatctaccaccagatcatgagctccaagaccgtcaacatgatgaagatcatcacgaaggtgaccgggtgcctcaaggaggaagtgaccggctaccgggtcgacagcaagtacaaggccgagttccactccttcgccagctaccgccagttccggaacaagatgctggactacggattcgacgtgcagaccctgaacgtggagatgttcgacaagctcgccgccaagctgacgctgaacaccgagtaccaccagatcatcacccagctcgaaagcctgaacctgggcctctccaaggagctgatcgagaagatcgcagacttccgcaagaagaatcgcagcctgttctccaagtggcacagcctctccctgaaggccatgaacgaggtcgtggacgagctgtggagcacctccaagaatcagatgcagatcttcagcgagctcggcgggttcaagtccaacatcgaggtgttcaagggcctgaagtacatccccctggacgccatggtcgacgagatctacaaccccgtggtccggtgcagcatccgcgagtccatcaagatcattaacgccctcctgaagaagtacggggccctggacaaggtggtgatcgagatgcccagagacagcaacgagaaggaggagaaggaccgcatcacgaagctgaacaaggagaacgacaacaagaagaagcaggcgatcgagaaggcccggaacgaatacggcttcggggaggaggcctaccgccagcagaacgacctcaacaccaagctgcggctgtggtatgagcagaagcagcgctgcctctactccggcgagatcatcaagatcttcgacctgatcaagaacccgcacctgttcgacatcgaccacatcatccccaagagcatctcctacgacgacagcctctccaacaaggtcctgtgctacgccaccgagaaccgggagaagggcaacctgaccccgtaccgctacttcaagcggaaggccagcctcacgtggaactatgaggcgtacaagtcctacgtgatcgaactgtacaaggacgggaagggcgacctgagccgcaccaagctcgagctgctactcttcgaagaggacatcaacaagtacgaggtgcggcagcgcttcatcaaccggaacctggtcgacacccgctacgccagcaaggtggtgctgaacaccctccaggacttcatgaaggagaactaccccacgactaccgtagaggtggtgcgcgggaagttcaccgcccaactgcgacggcactggggcatccgcaagaaccgcgacgagaaccacgcccaccacgccatcgacgctctgatcatcgcctgcgtcccgcacctctccctgtggaaggagcagaagaaggtgttcagcacggacgagttccgggtggacgagaccaccggggagatcattgagcagtcctacaaccagctgacctaccaggagcccttcagccagttcttctaccagctcgagaaggtctccatcgattgccgctacagctataaggtggaccggaagttcaatcgccaggtggccgacgcgacgatctactccacgcggcagggaatcgtcaagcagaccagcggcgacaagtccttcaccctggactccaactccaaggagcactacgtgatcgcaaagatcaagaacatctacgaggacgtggacgccaagcgcttcatggaccggtacaagaaggacaagacccagttcctgatgtaccaccacgacccccagacgttcagcatcctcgaggacgtcatgaagacctaccccgacaagaagaacccgttccaggcctaccgcctggagtacgggcccatccggaagtactccaagaagggcaacgggccccagatccagagcatcaagtactacgactccaagctgggtcagcacatcgagctcaagcaggctaaccagagcaccaagaaggtggtactgcagtccctgaacccctggcgctgcgacatctactacaacaagaaggacaagcggtacatcgccgcgggcctcaagtacgccgacctgagctaccagaaggggaccggcctgtacgggatcagcctccagcgctaccagcagatcctcaactcagagaagatcgagctgagcatcgagcaaatcgagttactgctggaaggccggctcaacgagtccaacttcgagttctgcttcagcctgtacaagaacgacttcatccagtggaacgacgagaataaccagacgttccaataccgcttcctggcccggaacctctctagcccgaaccgcatcgaggtcaagcccatcaacaagtccaagtacgacaagcaggccgaggggctgaagaccctgaagaagggcctcaaccggttctacaagatcagcgtggatgtgctgggctaccagcacttcattaagaaggagaagctgaagctaaccttcaagtga

SEQ ID NO: 7402 - RNA, 3330 nt, synthetic construct; identical to SEQ ID NO: 1602
  misc_feature 1..3330: note = Cas9 variant
  source 1..3330: mol_type = other RNA

SEQ ID NO: 7403 - RNA, 3333 nt, synthetic construct
  misc_feature 1..3333: note = Cas9 variant
  source 1..3333: mol_type = other RNA
atggccgaaggaaagaaacggatatggcgactaggcgctgatctaggcgcaaactcactaggatgggccgccatcgaactgagcgcaccggtaaatggcaagcctatcgcgatactcgcagcaggatcaagaatattcagcgacggaagagaccccaaaagcggggcatcactcgccgtagaccggagagacgcacgcgcaatgagacgacgacgcgatcgttttaaacaaaggcaaaaagcactgatcaaatacctaatcgccgacggactcttcccggccgacgaagcagcgaggaacgcaatggcagcaattgacccatacgcagtccgcgccagagcactagatgaagccctaagtttaccagagctcggccgagccctcttccacctaaaccagcgacgaggattcaaaagtaacagaaaagcggatagaaaagcagacgacgacgcaggtaagatagcaatcgggatcgacagaacacgagacgcaatcgcggaagacgaagcagacgcaggcgcagagccagggagctggacgttcggcaaatggctacacgaacgccgcctaaaaggccaatccgtccgcacgcgactaagaccagaatccggcgaagacgctaaaggagacgggtacgacttttacccagaccgcgcactgatggaagaagagttcgacgccatatgggcggcccaggcaccacaccacccggacgtacttactaacgacgtccacgaccggctccacgaaataatattctatcaaaggccgctcaaggccccacaagtcggaatgtgcagtctgataccaggagaccgccgactaccaaaggcccatcccctcttccaacgacgaagattgctagaggaacttaacgccctgatgatcgtgcgaccgggcgaagtagcacaacgcctaacacgagaagaaagagacatccttctcctaaaattaaaagacaaaaacaaagtcagcttcgcaactttacgaaaggccctaaaattagaccccgatgcacggttcaacaaggaatcagaagacagaacggacctaaaaggcgacgaagtagcagcagtaatgggcagtaaaacccggttcgggaacctctgggtacacctgagcatcgaagcgcagtgggacgtcctcgcacgtttagacgcggtcgaaagcgatgccgaagacgcagccttctgcgcatggctagtagaaacgtacgccctaacacctgaacaagccagggccgtggcaaatgctccactaccgcccggctacggcagattcggtgaaacagcaacgcgaaaattaatcgaagcattacgggacggaaagaaggacgaccgcgtgctcgtatactccgaagcagtaacggaggccggcctagggcaccacagcgacaggaggactggagaggtatttgaagacgcaaagggtagaccacaactcccgtactacggggtagcactcgaaagacacattatgccgggcaccggcgacccctccgacccagaggagatgagagttggacgactcacgaacccaacagtccacataggactcaaccaactacgacgaatactcaatgtactaataagagcttatggaccaccagccgaaatcgcaatagaactagccagggagctcaaacttaccgacgaggataagaagagaatcaacagagagaacaacgacaaccggatcgcggccgagcggcgcagcgagaagctactagcaataggacaagccgatagcggggccaacagagcactcttaaaactttgggaggaactgaacccagccaacgtactagacagacgctgtatctactccggacgccaaatatcgatcgacatgctatttagtgctgcagtcgaagtggaccacatactacccttcgcggccaccctggacgactcaaatggcaacaaaatcgtctgtctcagagaagcaaacagagagaaaagaaaacgatcaccccacgatgcctggggacacagcgcaagatgggacgaaatcgcagcaagagcagcccaattaccccggaacaaacgatggcgattcgaaccagacgccatggacaagttcagagacgagggaggtttccaggcgagacatctggtagatacacaatacctagcccgcctaagccgagagtacctggccacactgtaccccgagaagggggaaggctcagggcacatctgggtcagccccggccgactcaccgaaatggtacgtagaaaactcggcctaaacgatctcctaccagaccacaacttcgggggaggagccgaccaagccaaaaaccgactagaccacagacaccacgctatagacgcagttgtggtagccattgtagacaggggcatgctaaacgcaatcgcccgagcaagcggacaagagggggctgaaggcagagaacgaataataatcccagaaccctgggacggcttcagagacgcactacgagaaacggtaaaccgcatcaccgtgtctcacagaacagaccacggcaccgccagcaaagctgggctaccaaagggaaaagacgccaccgcaggacgactccacaacgatacagcatacggcttcaccggtgacaccgacgcaaaaggaaactccatcgtggtacgcagagtcccactttcctcattcaagaaattggcagacctcgaccgcatacgcgacgccgacctaaaagcagccctctaccaacacctaaacggcctggagggcaaggccttcgagaaagcactggccgagttccacaaactagaatggcacaactttggcggagtaagacgcgtaagggtaaccgagccactgaccgtaatccccatcaaggacagaaacggccgcatatataaaggttacaaaggcgactcgaactaccgctacgacgtctgggaactcccagacggaaagtgggtgaccaactggaaaaacgaagcaggcgaagcaatgagcagcgttatatccatgttcgacgctcaccaaagcagcgaaccaccacgcccacacccagccgccagaaaaatactgagtctgcaccagaacgacctgctagcgatagaacgagaaggggaagacagaaaactaatgcgagtggtcaaatttggacaaagtgggcaaataacgctagcggaacaccagcaggcaggagacctgaaaaagcgcgacgccgtctcaaacgacgatgatccattcaaatacttcgcaccaacatccggaggcctgaaaaaggtcaaagcgagacaggtcagaatagatgaaatcggcagagtcctagaccccggattccccgcccggacagctagacgcaaaacacgcggctga

SEQ ID NO: 7404 - RNA, 3333 nt, synthetic construct
  misc_feature 1..3333: note = Cas9 variant
  source 1..3333: mol_type = other RNA
atgacagcacgcacccataaaatatggagactcggagcagacctcggagctaattcgctcggttgggcagcaatagaactctcagcacctgtcgacggaaaaccaatcgcaatactacacgcaggatcaagaatcttctcagacggccgggacccaaaaagcggggcaagcctcgccgtcgacagaagagacgcacgcgcaatgcggagacgacgagacagattacaacagcgacaaagggcactcataaagtatcttatcgcagacggactcttcccagcggacgaaaacgagcgcaaagccatggcaacaatagacccatacgcagtccgagccagagcgctcgatgaagcactaactctgcctgaagtcggccgggccctctttcacctcaaccaaagaagaggcttcaaaagcaatcgtaaagccgacaggaaagcagacgaagatgcagggaaaatcgccataggaatcgaccgaacaagagatgccatccggcaggccgaagaagaggcaggagcagaacccggaagttggacttatggaaagtggctctacgaaagacgagcctcagcaacagacgccaacgcaataccatccgtccgtaccagacttcgaccagaaacggacgaacacgctaaaggagacggctacgacttttatcccggacgcgcgctcatggaggcagagttcgccgccatatgggaagcgcaggcagcccaccaccccgatgccttaacaaatgaagtacacgaccgactacacgaaataatcttctaccagcgcccactaaaggcaccccaaatcggcgtatgcacactcataagaggggaccaaaggctacccaaagcgcatccactgttccagaaaagaagactgctcgaagaactgaacgcactgacgatcgtaaggccaggcgagatggcgcaaagactaacacgagaagaacgagacacccttttcctgaaactcaaagacaaagccaaagtatcattcgtgagcctcagaaaaaccctgaaactggacccagacgcaagattcaacaaggagagcgaaaacagaagcgacctaaaaggcgacgaggtagcggcagcgatgggagcaaaaaccagattcggaaacaggtgggtacacctatcaatcgaagaacaatgggacgtgatcgccagactagaagaagtcgagagcgatgcagaagacgcagcatgccgagcctggctcgcggcaaccttcgacctgacaccagaacagatacgcgcagtcaccaacgccccactaccaccagggtacagccgcttcggaaaagtcgcaacccagcgcctcatagacgcactcagagacggcgagaaagacggacgcgtcctagtatacagtgaagcagtggcggcagccgggctaggtcaccacagcgacctacgaacgggagagatcttcgaggacgctcaaggcaggccacaactgccctactacggcgtagcgttagaaagacacatcatgccaggtacaggcaatccggaccacagcgacgaaatgcgaataggacgattgacgaacccaacagtccacatcggattaaaccagctccgacgaatcgtgaatacactaataagagcttacgggcccccggccgaaatcgccatcgaactggcgagagaactaaaactgacagacgacgacaagaaaagaattaacaaagaaaacaacgaaaaccgactagccgcagaaaaacgcagcgaaaaactcctcacgataggacgcccggacaccggcgcaaaccgcgcactcctcaaactctgggaagaactaaaccccgccaacgtgcttgacagacggtgcatctacactggaactcaaatatcagtggacatgttgttctccgcggctgtggaagtcgaccacatcctaccatttaccgcaacactcgacgattcaaatggcaacaaaatcgtatgcatgcgcgaagcaaaccgaacaaaacgtaaacaaagcccgtacgaagcgtggggacacacagacagatgggaggaaatcgcagctagagccgcacaactaccgcgcaacaaaaggtggaggttcgagcccgacgcaatggaaaaattcaaagacgaatcgggattccaagcccgccacctcgtggacacccaatacctagcccgactgagtcgagaatacttagagacgctataccccggatccggagagggctccagccacatctgggtcagccctggacgcttaacagaaatggtcagacggaaactcggactgaacgaccttctccccgaccacaacttcggaggcggcgccgatcaggcaaagaacagactagaccacaggcaccacgccatcgatgcggtagtcgtggcaatagtagacaggagtatgctcacagaaatcagccgcgtcagcgggttggaaggcgcagaaggcagagaaagaattataataccgccaccatgggatgagttccgcaacgacctccgaacagcagtcaacgccattacagtatcacaccgaacagaccacgggaccatctccaaagcaggactacccaaaggcaaagatgcaaccgccggaagacttcacaacgacacagcatatggcttcacaggcgaaaccgacgcaaaaggaaattcgatcgtcgtacgacgcgtcccgctagcctcattcaagaagctggcagacctagaccggattcgagacacagacctcaaagcagccctatatcaacacctagaaggcctcgaaggcaaggccttcgaaaaagccgtaatggacttccccaacttagaatggcacccattcggtaacgtcagacgagtccgcgttacggaagtgctctccgtgatcccgatatcagaccagaacggacgcatctacaagggatacaaaggcgacagcaactaccggtacgacgtatgggaactacccggcggaaaatgggaagcagaagtagtcagcaccttcgacgcccaccagcccgactgggtatcgaaaatcagatcacgctcccccaccgcacgcaaagtactaagtctacaacaaaacgacctaatcgcagtagaacgcgcacacgaaacacgcgaactaatgcgcgtagtaaaattccgccagaacggcgaaatcacattcgcacccccacaagaagctgggtctctgaaaaggcgggacgccacgccaaacgaagacgacccatttaagtacttcgctgtagccgccagctcgctgcaaaaagcgaaagcacgacaggtgcggatcgacgagctaggccgcgtcttggaccccggcttccccgcacgcacagcccgacgcaaaacccgaaaaagcacatga

SEQ ID NO: 7405 - RNA, 3333 nt, synthetic construct
  misc_feature 1..3333: note = Cas9 variant
  source 1..3333: mol_type = other RNA
atgcgcatactggggttcgacatcgggatcaccagcatcggctgggcatacgtagagggagaggagctcaaggactgcggcgtgcggatcttcaccaaggccgagaacccccagaacggggattccctcgcggccccgcgtcgggaggcgagaggcgtgaggcgccgactggcccgccggaaggtgcgcctcaacgtcataaagcggctcctgtgcaaagagtttggcctcaacttgagcgactactttgccaacgacggtgagctgcccaaggcgtacgaaacgaccaaggacaccaagtccccctatgagttacgctcgctggccctggagcagaagctcgaacccaaggagctagcccgggtcatcctgcacatcgccaagcaccgcggttacgggaacaagcacgcgaagcgggacctcgaggccgaagagaaggccaagaaggccgcggagaaggcgccacaggagaaggagtccaccacgacgaacggggattcgaaaaaggagcaggagaaggtgctgaaggccctgtaccagaacgagaccctcctcaagaaataccagaccaactatcagacgaacaataaaactaacgacgagacaaacaacaaaaccattttcttagtcgggaagtacctatacaaggagttccaggacaagggccagcggatcaggaacactaccaataactaccagcacacgatgcgccaggaatggctgaaggacgagctggagttcatcttcaaaaagcagaaggactttggcgctaccttctccgaaaactttgagtcccaaatcttggagacggccttttaccagcgggacctaaagagcttcgaagacaaagtggggaagtgcgtgttctatgagaacgagaaccgcgcacccaaagacagcctttctgcgatggagttcgtcgctctcaccagaatcatcaacactctgaaaaacctggagaagaaatccaaaaacctaggcatcggggagacttacggcaaggacaagatccaggagatcctgaagatcgtgctggacaagggcgagatgagctacaaggagctccgaaagatcctgaagctcaacgagtccattctcttcgccaaggactcaaagctggactacacgaaagggatgcaggaggccgagaaggccaagttcatcgagctgaagaacctcaaggcgttcaagaaggccatgggcggggatttcagcaaattcccccgcgaggagctggataagatcgccaccgacatcgttttaatcaagtccaaggagaacctcgctaaaaagctgcagaactacagcgcgctgtccaaggagcaggtcgaggcgctcagcaatctgaacttcgccaagcacatcgacctgtccctcaaggcccttgacaagatcctgcccttcatgcgggagggcctgtcctacgacgaagttgtgaaaaaggtagggctccaggagcaccgcaagtacaaacagaagggcgagttcctgatcccgctgaaggaatacgaaccctatctcgccaacccagtggtggcgcgggccctaagcgagtaccgcaaggtcctgaacgccctactccggaagtatggaaacgtgcacaaaatccacctggagttcacccgcgaagccgggaagaactacgacgagcgaaagaaaatcgaaaaggagcagcgcgagcacttcgaggccaaccagaaagctatcaagcagcgggagatcttaggcctgcccataaacggggcaaacatcctaaaaatgaagctctggatcgagcagggcgaatgctgcgtgtactccggcgagaaaatcacctctaagcatttcttcgactccaatgcgctccaggtcgaccacatttacccctacagccgctccttcgacgacagctacatgaacaaggtgcttgtgttcgccaaggagaaccaaaacaagttaaataagactcccttcgaggccttcggctccgacaaggagaagtgggaccggatcctgagcctgagtgcgaagctccctaaacagaagcagcgccggatcagcaataaggacttcaaggacaaggagctgggcttcattgcccgcaacatcaacgacaccggttacatcgcgcgcctggcctcccagtggacgaacaactgcctcaagttcgaagaccttcgcgagaacgaggtcaccatcgccggcgagaaggggagcaagaaccacctcgaagtgatatcgggtcagctcacgagcatgttacggcactattgggggctgggagataaggaccgcaacaaccatctccaccacgcggttgacgccgtgatcatcgcctacaccaacgcgaaaaccatcaaggcgttcgccgacttcaaaaagaaccaggagcagaaccgagccaaattctacgccaagcagatctccgagcaggagtacaagagacagcgcaaccccttcgagccgtgcgccaacttccggcaacgggtggaggagaaaatcaacaagatattcgtctccaagccgcccaggaagcgcgcgcggggcgccctgcacaaggaaacctttgggagtatctgcctagacggcaacaacaactgggtggcaaggttcaagattaagagcaaaaaggagcaggaggacatcacaaaggagaaagccactaaggcgaagtacaaggatgagttcaagggggaggagaacattcggaaggcgctcaagctgggtaagatccgccggatcaacaacacacagaaagacatcgccatcggcgacaaaatagtgaagaatgaaacgatggtccgcgttgacatctttaaggacaagaagggcaaattctacgccgtgcccatttacacgatggacttcgctctggggatcctcccgaacaaggccgtcgcgaccggggaggatgaggacggcgtgatcaaggactggattgagatggacaagacaaagtacgagttctgctttagcctgttcaaagacgacctgatcaaggtacggaagaagaaaatgaaggaagccgagctctgctactttgttggatttgacaccgacggctcccgaatcatcgttgccaagcacaacaacgactatcagaccatgacggagaacgagtgtaagctgttcaccctgaaagagaagaagaagaagcagaagaccctcaacgacgaggaggacaaccaggagcggatcgaaaccgagtacaagataatcggcggacgcacgggaatacagaacctggagacgtttgagaagcaccaggtgagccctctcggagaggttcagaaggcggagttcgaagaccggcaggagattaagctgaagtccagccccaagggaaaggactga

SEQ ID NO: 7406 - RNA, 3333 nt, synthetic construct
  misc_feature 1..3333: note = Cas9 variant
  source 1..3333: mol_type = other RNA
atgtcggaaaagtaccgcctcggcctcgacgttggcacaaactcacttgggtgggctgtcataggactcaaagaagacgtcccctcaagcgtcctggcgactggcgtacgcatcttcagtgagggaagggatgcaaaaacaaagtccacactcaaggccagcagaacggagaaacgcagcgcccggcgaagacgcgacagattcctccaaagacaaaccttccttatctccgaaatggtaaaaagcggcctctttccaaaagacatagtcgaacagaaaaacctcgaattgctggacccctacgaaattcggttcaaggctttgaccgaacaagtcccactccaccacctggggcgagcactcttccacatcaaccaaagacgcggctttaaatcctcccgaaaagacaagagtgaggaaacaacctcgggagtcgtaagcaaaagtgtccgcgctctctacgaagaaatgcaactcataaacccagcccccgtgatcgacgacccaaaagcccttagtaaagaggagcgacgagagatacgggtccaggaggcatcctcaagagaagaggccttagtgaccctagccgagcaaaaaggagtaacgttcggcgctttcctataccgacggctccagtcaggcaaaagcgtccgcgcccgcaaggacgcagattcacaactgtatgacgtgtacccgaccagagagctactgaaggacgaatacagcaagctcatgcaacaccaagcacaatattacccaaacgtcatcaacgaagccctcataagccgcctacatgacgtcatattcttccaacggaagctaaaagaacaagagcggggcttctgcacgtactaccccagcgagaggaggactttcaggtgcatgccatcattccaacaataccgcatggtgcaagagttaaacgccctagaatgggtagacgcagccggcaaacactgcctacgagactaccccgaaagcagagacctgatactaagcgagctagaaaacattagcacaaaagccggagagttcacattcgggaacatgaagaaaatcctgaagaaaatgggggtcatcgacggggaagtctcctttaatttcgaaggccccaaacgcaaagggttccagggaaacgtaacctccagagaaatgcgccacgaagactgtttcggcacccgctgggacgaactatcactcgacgaaaaagacgacataatcgacaaaatcaacgacgaccaccttgacgacgaggacatggagcgctacctcatcgacacatacggcctgagctccttcagcgtcggtaacgctatcaacgcccgattactagaaggtaccgccaacgtcagccgcaaagccgcccgcacgctttacgaaaccatgctgtcagccaactgcctacaaagcgatgcggtaatagccgtttcagaacaagacgacacgttcgtcaatccatactcacgcacgggacgcggtgaactcctcagcgagctcccatactacggcgaggcattccaagacgggagacacatcatcccaggaaaaagagagcccaaagtctcacacgaccagctgaaattctacggaggcgtctctaacccaacagtccacatcgcgctcaaccaaatccgactggtcgttaatgagataatcaaacgctacggcctcccaagctccattagcatagaactagcaagaaacctacccgagggacaagacggcaggcgaaaaatcgagaaaatgcaaagtgaaaaccagaaaaacaacgaacgctacgaccaaattctaacagaaaacgggcaaagcccaaacagagataacagactaagactagcgctgtgggaagaactaggcgaaggaccaacggaccgactatgtgtcttcacaggcaagctaatcgagctggccgacttattcaacggctcagtcgagatagagcacctcataccattctcagtcagtctagacgattccaaggccaataagacggtttgttggaaagaggccaaccgcttcaaaggaaacaaaaccccctatgaggcattcgcaaacaatagcggagactactcgtgggaagaaataatggaaagggtcagagcgctgccaaacagcaagcaatggcgattccaagaggacgcactcaaaatctggaacagtgaccacagcgacttcagcggacgacatcttaacgacacacgctacatatcccgcctagcacgagaatacttagagaacatctgcccgttcaacaaaatcgacgtcgtcaccggccgactaacagcacttcttagaggccactggggcctaaacaacatcctgagaggacacaacgaacccgaaaccgccaccccaaagaaaatgcgggacgaccaccgacaccacgcaatcgacgcggtggtaattgcgatgacatccctaacaatactgcaaaaagtgagtagcgcggcagggaaagcagaagaattagacgtcggcaaactcttcgctaaagacgaaagcggcagatcagtgattgacccatgggacggctttagagacgaggtagccgagaaagtccgaaacataatcgtctcccacaaaaccaaacgaaaaaccataggtaactccggaaaaagcacggaccgagccctccacaacgaaacagcctacggactcatagacggccccgacgaaaaagggctctacagcgtggtaaccaccaaaccgatttcatacttcgacaaccgggacaaaatcgagaaaatacgtgacgaaaagctaagagacgatttcctgacagcatgggacggcgaaggggacaacaaagcctcccaactcgcagtcctcgacaaagcatctggactcaacgtcaagaaatgccgatatgtggagcggaaaaaggtcatccccatcaacggacccgacggacaaccatataaggcgtacgatggcaattccaactggggcatggaaatatatgagttcccaaacggccaccccaaagaaaagaaatggaatggcgtcgtgatatcaacgtacgacgcgaacaaatcggaatttaaacccggggaaacattcagaccccaccccgccgcaaaactcgtgatgagactacacataaacgacatagtggaagtacagaatgacggagaacccattctctacagagtccaactcatctcggccgggacactgacagtctcgcctctgcacgaagcaaacgtggactcacggaaccgagataagcatgacgagttcaagtacaaaagcctaagcgtcaccccaatgcagaaaatgggagcaaagaaagtcaacatatcaccaaccggactgaagaactacagccgctga

SEQ ID NO: 7407 - RNA, 3345 nt, synthetic construct; identical to SEQ ID NO: 1607
  misc_feature 1..3345: note = Cas9 variant
  source 1..3345: mol_type = other RNA

SEQ ID NO: 7408 - RNA, 3345 nt, synthetic construct; identical to SEQ ID NO: 1608
  misc_feature 1..3345: note = Cas9 variant
  source 1..3345: mol_type = other RNA

SEQ ID NO: 7409 - RNA, 3348 nt, synthetic construct
  misc_feature 1..3348: note = Cas9 variant
  source 1..3348: mol_type = other RNA
atgagcgcaacctacaccatcggcctggacataggcatcgcgagcgttggctggtgcgcgttcggcgaaacacacatactcgaccttggcgttcgcgcgttcgacaaagccgaaacagccaaagagggcgaaagcctgaaccttgcacgcaggaacgcaagactcatgcgcaggcgcctcttccgtcgaacgtggcgcctcaagaaactagcacggcaactcaaaagtgaaggccttatcgcggacacgaaactcttcaagccggaattacccttctccaaaagcctatggcagctcagagtcgacggccttgaccgccgacttaacgacgaagaatgggcccgtgtaatctaccacctatgcaagcaccggggattccactggatttcacgagcagaagcaaaacaagcagagggcgactccaagtcggagggtggcaaagtgaaacaaggactggcgggaacggccaagctcatggacgagaaaggctaccggagcgctgccgaaatggtgctcgccgagttcccgcaggcgcaacgaaacaaacagggcgaataccaaaaagccctatccagggaactgctcgccaaagaactcgctctcctgttcgcacagcagagagaatacggcaatctacacacgccaggagcgctagaaaccgcaatactcgggaacggcgacaagaaatcggggctgttctggcaacaaaaaccagcactagcgggaacagacctcttaaaaatgctgggcacctgtaccttcgaaaaaggcgaataccgcgcccccaaagcctctttcacggcagaaagacatgtctggttaacccggctgaacaacctaagaatagtcacggacggagtaacgaggcagctcacggaacaggagcgacaactatgcctacccctaccatatagacaagcaggagatctcacctacaaacaactgggcagcgcgctagcgaaagctggactactagaagcgggtggattcaagttcaccggactcgcatatccaacggaagcacaaaaggccgaaggcaaggcaaaggaccccgaaagtgcaacacttgtaaaaatacccgcctggcatgaactcagacagacactcacaaaaggaggactaaacgacgaatgggaaaaacttgcaggcgacgccctatgtggacaacccgaaatcttcgacaaaatcgcgtgggtgctatcagtgtacaaagatgacgacgaagtccgtgcggaactagccaaactagcgctaccgaatccccaagcactgaccgaagcccttctgaacatacgattcgacaaattccacagcctctcgctaaaagcccttcgagccatcgtcccacacatggaacagggcctcaggtacgacgaggcttgcgtccaggcgggctaccatcacagccaactcctcaaagtaggcgaaggcgaacacaagtacctgccgcccttatacgacggtcgggacggcgatgggagaatgatattcgccgaagacgccgacattcccagaaaccccgtcgtactgcgaagtctgaaccaggcacgtaaagtagtgaacgccataatacggcgatacgggagcccctccgccgtccacatcgaaatggcgcgcgacctatcaagacccttcgacgaacggaacaagataaagaaagaccaagacgaataccaagcgcgcaaccaacgcgaccgagaacaattctcagagctattcggtcatcccccaaagggtctagagttcgaaaagtggcgactataccgcgaacaaaacggccagtgtgcatattcccaacgacctctaacggcgtccggcaacgtcgcagaaatcttcctcgacggctcaaccgaaatagaccacgccctcccgtacagcaggagtttcgatgactccaaaaacaacaaagtactcgtactaacaagagagaaccgagacaaaggcaacagaaccccatatgaatacctgggaggcgcagaaaactcagagtcctggcaaaggttcgtgagcttcgtcgaaagcaataaggcataccgtctggccaaacgaacacgcctactccgaaaagactttggggcgaaagaaagcgaagagttccgagagcgcaacctaaatgacactcgatacgtctgcagattcttcaagaactacgtggagcagcacctaaaactggcagaaggcagcgaaacaaaaagatgcgtggtcgtcagcggacaactcacaaacttcctgcgagcacgctggggccttctaaaagtaagatccgacagcgacagacaccacgcactagacgcggcagtagtagccgcatgcagccacagcatggtccaacgactcagcaactacagcagaacccgcgaactagaacaagtaagagacggattcgtagacatagaaacaggagaaatagttaacccagcgatgcatcaacaacttcgggaacacttccccgacccatggccctacttcagacacgaactcgaggcccggctcaaaatagacagccccgaattactacgcgaggaaatggccagactaggaagctactccgaggaagaactaaaagtcctcaaacccctattcgtaagcagagcgccccaacgacgaaatggaggggcagcccacaaagacaccatctacggacaaccggaaaaactaaagaaaaacggctcagtgacacaaaaagtcgccctcacaagtctcactctaaaggatatagatctactcgccgacccacatagaaacgccaaactctacggagctatacgcgaaagactggaggcacacggcggcaagggagataaggccttcccggccacgaacccactccgaaaacccgacaaagagggtaacccaactggaccgatagtaagaacagtaacaaaagtaatagacaaactgagtggcatcccagtgagaggcggcatcgccaaaaacgacacaatgctccgagttgatgtattcacgaaagggggaaaattccacctagtaccggtttacgtacaccaccgggtcactggattgccaaacagagcaatcatagcattcaaagacgaggatgagtggacgctaatagatgactccttcgactggtgcttcagcctatacccaaacgacctactccggataaagctcaaaaaggaatcccacagcggctactactcctcctgcaaccgaagcacaggcgcagtcaacctatgggcccacgaccgcaacgtaaacgttggcaaagacggctttatagaaagcatcggggtaaaaatggccgtaagtatagaaaaactacacgtagacacacttggcaatatatacccagcaccaccagaaaaacgccgcggactggcctga

SEQ ID NO: 7410 - RNA, 3351 nt, synthetic construct
  misc_feature 1..3351: note = Cas9 variant
  source 1..3351: mol_type = other RNA
atgtcccaaaaccaaaaccccaacacgcagagccacctcaacccaacaacacaatcgtcgacccaatcaaacccacaacccacgacacaggaatcacttaaaatactaggcttcgacatcggagtcgcctcgatcggctgggcgttcgtagaaggaggggagctaaaggactgcggcgtccgaatcttcaccaaggccgaaaacccaaaagatgggagcagcctcgcactcccaaggagagaagcacggggtgtaaggcgacgactggcccgcaggaaaggacgcctcaacgcactcaaggtgctcatctgcaaggagttcggccttaacaggagtgactacctagccacggcaggcgaactccccaaggcatacgcaacatcgaaagaaactaaatccccctaccaactccgcgcggagagccttgaaagaaaactctcggctgacgaatttgcccgcgtcatccttcacatagccaagcaccgagggtacggaaacaaacacgcgaaagaaagctcggacgacgactccggaaaggtcaaaaaggcgatctcggaaaatcagaaggtaatgagtgaaaagggctacacaaccgctggccagtacctgtacggagagttctaccaaaaagcgcgaaacttcagcgaagccgaacccaagagccccaaaaacgcgcgcggtacccaggagttcaagaacgtccgaaacaagtcagaaaattacgcccgatgcctagcccagagcgagttacaaaaagaactcgagatcattttcgcaaaacaacgcgagttcggattccaattcagcgacaagaaacacaaaacaatcaacgccaatggcaaactcaaagaactcgacttcgccgacgcagtccttgagatcgcattcctacaacgaccactcaagagcttcgccgacaaagtaggcaaatgcaccttctacgaagacaagccgcgcgctcccaaagactcattaagcgccatagagttcgtcgcacttacccgcataatcaacaccctagccaacatcaccaaacgatccggcgaagtctacagcgcagacaaagtgcgcgaaatcctcagcattgtattagacaagggagaaataacatacaaaaatttgagaaaagtcatagcactcgatgaaagactccagttccccaaagactcaaaactggattacgccaaagaagatgcggaaaaggcaaaagccatcgagttctcaaaactgaaggccttcaggaaagccctcggcggcagcttcgaaggattcatacgagcagaactagactcaatcgccacggacatcgcattaataaagagtaaggacgaactaaaggcaaaactcgccaactaccagagcttaaacgacgaacagcgcgaaaaactatctgaactctcgttcgacaaattcatcgacctgtccttcaaagcactagaagccatccttccgctcatgcgcggcgacaaagacgacaaaatctataggtacgacgaagcatggcgcgaagcaggcctcgtcgaagtcgcaaagaaaacccaaaaaggcgactccctgccacccctaatcgaatatgaaaaggacctcgcaaaccccgtcgtagcccgggcactcgcagaataccgcaaagtcctcaacgcgctcttaaagaaacacgggaaggtacacaagatacatctcgagttcacacggcaagccggagtcagcagcaaagaacgaggggaaattatcgccgaacagaacaaacgtctcaaagcaaacgaagaagccagaaagcgctgtgaagaatacggactaatcccgagcgggaaaaacatactgaaactaaagctatggcaggaacagggagagttctgcgtgtattctggtaaaaagatcacccaatcagacctccgagacgaaagcacactacaaatcgaccatatctacccatatagccgcagctacgacgactcccaaaacaacaaagtccttgtgtttacggacgccaatcagaacaaactaaatcagaccccatatgaggccttcggaaaagacatcagcaaatggaatcaaatactcggacgcatcgaaaaactgccaaaagcaaagaaaaaccgaattacaaacaagaacttcgcaaacaaagaggcagggttcatcgcacgcaacatagtcgacaccagctacatagcacgactgagcgccagctacaccgacgccttcatcgagttctgtccactagctgaaaatgaagataccaccctaggccgaggagaaaagggtagcaagaaacatatatcagtagtaaatgggtcattaacagccacaatgcgacactattggggcctaaatacactactggacggcgaaaacagcgaaagcaaagaccgatcaaaccatctgcaccacgcactcgatgccatcattatcgcctacgtcaacgacagcgtcattaaagcattctccgacttcaaaaagacacaagaacaaaataaagcccgacttatagccaaagaaatcgaaagcgcagagtacaaaatatcccggagatttttctcaccgtcaggatttgagaacaacgaagcgttccgacaagcaatcaagcgaaaaatcctcggacagtcgctcgaatcaagagaaaatgacatgaccataaacagcgaggcattgggagaaaaagtcggcggcatcttcgtctccaaaccaccaagaaaaagagcacgaggagccctacacaaggaaacattcagctccatcgacgacaaggacctgctaaagacatacggaggaaaagagggcgtaaaccgcgccatcaaacttgggaaagtaagacaaatcggcagcaaaatagccgacaatggaacaatggtccgagtggacatatttagacacaaggtatccggaaaattctacggggtccccatatataccatggacttcgccctcgggatcctcccaaacaaagccgtcgtaggaggcaaagataaatccggcgtaataaaggactggctccccatggactccaactacgaattttgcttcagcctcttcaaagacgatctaatactcgtccagaaaaaggagatgagcaaagcagagctctgctacttcgcgggattcgacacctcagggggacaaatcaaggtagagaaacacgacaaccactttgccaccctcaccgacaaccaacgactcctgttcaacatagcaaccccaaaagaagtggccggaaagtcaatcgggatccaaaatctaaaggtattcgaaaagtggcaggtatcaccactcggagaagtaagcaaagcggagttcaaagaacgtgaacccatcgcactcaaatcaacgccaaaacgcttcttgcaaggctga

SEQ ID NO: 7411 - RNA, 3354 nt, synthetic construct
  misc_feature 1..3354: note = Cas9 variant
  source 1..3354: mol_type = other RNA
atgaagcacatcttgggcctcgacctggggagcaactccatcggatgggccttcgtgcagcaggacttcgagaacaagcaggggaagatcatcgccaccggcagccgcatcatccccatggaccaggggatcctgggcgacttcgaacggggcaacaccgtttcccagaccgcggagcgcaccacctatcggagcatgcgccggctccgcgagcggcacctcctgcgccgggagcgcctccatcgggtgctgcacctcctcgggttcctgccgccccactacgacgcccagatagacttcaccaagcgctacggcaagtttatcgacaacgccgagcccaagatcgcctacaacaatgggaacttcatcttcatgaactccttcaacgagatggtggaggacttcaagaagcaccagccccagctgttctacaagaagtccaacggcgaggagagccggatcccgtacgactggaccatctactacctccgcaagaaagccctgagccagaagatcactcagcaggagctggcgtggctcatcctgcacttcaaccagaagcgggggtactaccaactgcgcggcgaggaggagaccgagaaccccaacaaggaggtcgccttccactccctcaaggtggtggacgtcgaggccgaggcccccaacaagaagggcgagatctggtacaccatccggctggaaaacgggtggatctaccgccggacgagcaagaaccccttagacgactggaagggcaagacccgcgacttcatcgtgaccaccgacctcaacgacgacgggacgatcaagctggacaaggagggcaaggagaagcggtccttccgcgcgcctgacgagaatgactggaacctgctcaagaagaagaccgagcacgacatcgatttcagcggcaagcccgtgggaacctacatctacgaccacctcctgcagaaccccaaccagaagatcaagggcaagctggtccgcaccatcgagcggaagtactacaaggacgagctgaaggccatcctggccaagcagatcgccttgcagcccgagctgttcacggagaccctgctcgccgactgcatccgcgagctgtaccggaagaacgagacccagcagcagaacctgctctccaaggacttcctgcacctgttcgtggaggacatcatcttctaccagcgcccgctctgcagcaagaaatccaccatcgcgaactgcacgctggagaagcggagctacatcgacaaggagaccaacgagcgcaaggacgcccccatcaaggtctgcgccaagtccaacccctactaccaggagttccgggtcctgcagtggctccagaacctgcgcatctacgagatcgagaccgaccgggaggtgacagccgagttcatcgagacgccccaggattacgaggccctgttcaacttcctcatgagccagaaggagatcgacaacgaggggctgctgaagtacttcctcttcgcgaagaacccgcagatcaaggacaaagcggccaagtccgagctgaagaagtggctgaccacctaccggtggaactacgtgtacgacgccgctgacaacagcagcaagaagtaccccatgaatgagaccggctacgagctgcagcggtaccttcagaaggtcgaggggctgcccgcgaacttcctgacgttcgacatcacctaccagctttggcacctcctgtactccgtgaaggacaaggtggagttcgagaaggccctgaaaaagttcgccaagaagaaacagctggacaagaccagcttcgtcgactccttcaagaacttcaagccatacccgaacgagtacggcagcttctccgagaaggccatcaagaagctgctccccctgatgcgcttcggcaaccactgggacttcaaccggatcgacgtgagcactcagaagcgcatcgacgacctgatcaacggggtggcgaacgaggacatacgcacgatcatccgcgagaaggcggagaagtaccagctcaattccgagacctgcttccaggacctgccactgtggctcgcccaatacgtcgtatacaaccggcacgccgaggccaccgatatcgagaagtggaccagcgtgtccgacctggaggcgtacctggaggacttcaagcagcacagcctccgcaaccccatcgtcgagcaggtcgtgacggagaccctgcgggtggtgcgcgacatctggcagcagtactccggcgggcaggccaacttcttcgacgagatacacatcgaactgggccgcgagctcaaaaagaccgccgaggagcggaagcagctgtctgacaagaaccaggagaacgagaacactaacctgcgcatcaagaagctcctggccgagcttaaggaggacgcctccatccagaacgtccggccgtacagcctcgtccaacaggagctgctgaagatttacgaggaaggggtgttctccagcaccgacgagatcgaggaggatatccagaaaattcgcaagaaggtcgagcccacgccgcccgagatccagcggtacaaactttggctggagcaaaagtacaagtccccctacaccggcgaggtgatcagcctgaccaagctgttcaccgaggagtacgagatagagcacatcatcccccagtcccgctactacgacgacagcctgagcaacaaggtgatctgcgagtccgcggtcaacaagctgaagacgaaccagctcggcctggagttcatccagaaccaccacggggagaaggtgcggatcaccgcgaacaaggaggtgaccatcttcaccgaggaacagtacaaggagttcgtcaagaagcactatgccaacaacagcgccaagcagcagaagctgctcctgaacgagatccccgagaagatggtggcccgccagcttaacgacacgcggtacatctccaagtgcatctccgagatcctctccaagatcgtgcgcagcgacgagaaggacgagggcgtcaactccaagaatatcatcccgtgcaccgggaagatcaccaccgcgctgaagcaggactggggcctgaacgacgtgtggaacgagctcatcctgccccggttcgagcgcatgaaccagctgacgcagacccagctgttcaccagctacaacgaccggctgcaaaagaaccttcccaccgtgcccatcgagtactcccagggattccagaagaagcgcatcgaccaccggcaccacgccatggacgccctcgtcattgcctgcgccacgcgcgagcacatcaactacatgaacaaccagcacgcgctggacaagagcaaggacaagaaggagaagcagcagtccagaatcgacctgcacccgctctga

SEQ ID NO: 7412 - RNA, 3354 nt, synthetic construct
  misc_feature 1..3354: note = Cas9 variant
  source 1..3354: mol_type = other RNA
atgcaaacgaaaaacctcctatacaccctgggactcgacatcggaatcgcatccgtcggctggtgcgtcctgggagaaaatagaatcatcgacctcggggtgaggtgcttcgacaaggccgagacaccggaccgaggcgagagcctaaacaaggtccgccgagatgccaggcttatgcggcgacgcctccgccgacgcgcctggcgtctcactaaacttgcccgcctcctgaaacacgcaggactgatcgactccaccagaattgtccgagaccggcatgacggtgcagtatcgccgtggcaactccgagtcgaaggactagacaggaagctcgcgccagaagagtgggcacgagttatataccacatcgtaaaacaccgcggattccactggatcagtcgggccgaagaacgtaaagcagaatccgataaaggagaaggtggcaaagtcaagcaagggttgtcagccacaaaacaactgatggtggagaaaaattaccgaagtgcagcagaaatggtactcaccgagttccccggcgcacagcgcaataaaagaggggaatacacgaaagcgcttagcaggattctattggcagcagaactcacaaccctgttcgaacgacaacaagaattaggaaacccccacgccggaccagacctacaaacaaagatccttggcaacggcgaccgcaaaagcggcctactatggatgcaaaagcccccactaagcggctcggcactactaaaaatgttaggaaaatgcactttcgagcgggaggaatatagagcgcccaaggcatctttcacagcagaaagacacgtctggctaacaaaactgaacaatcttcgggtactcgtcgatggagtaactaggccattaagtgacccagaacgccgactggccctatccctaccctaccagcaagcgagcgacttcacctacaaacaactccgagcggcactttgcaaaaacgggctgctaccggattcatttcagtttagcggacttgcatacccgacaggggcccaacaacccgacggaaaagccaagaacccagaaaacgatcgcttagtaaaactcccggcctggcaagagttccggaaaaccctaagagacgccggactcgaaaccgaatgggagagcatcgccggaatggcagcaggcggacaaccggacctcctcgatcaaatagggtgggtcctgagcgtctttaaagatggagacgaggtgctcagagaactcagaaaaataccattgcccgggggagagaaaatggtacaggccttatctggcgtttcattcgacaccttccacaacctcagcctcaaggccttgcgaaagatagtacctcacatggaggccgggctaagatacgacgaagcgtgcctggccgcaggataccaccatagtgacctgaggaaagacacagacgagagaagtctgtacctaccaccgctatacagcgggcgaacgaccgacggccgcatggtgttcagagacgacattgatgtacctagaaaccccgtggtattgcgcgcaatcaaccaagcgcgaacggtcgtaaattcggtcgttagacgctacggaagtccgagctcaatgcacatcgaaatggcaagagacttgagccgcccctgggacgaaagaaacaaagtaaaaagagcgcaggaagaataccgagacagaaacgaaaaactcaagatcgacttcgcggccgaatacgggatcgagcccaaaagccgagagttcgaaaaatttctactctaccgcgaacaagggggtaaatgcgcatactcgcttaagcccctagacctagacagggtcctccgcgatctaggttacgcagaagtcgaccacgccttaccctacagccggtccttcgacgacagcaaaaataacaaagtcctggttctcgcagaagaaaaccgcaacaagggcaaccgaaccccctacgaatacctcgatggaacctccgaaagcccgaggtggagagagttcaaagcattcgtggaaacaaacaaagcctacagattggcgaaacgagcaaggcttctccgaaaagacttctccggaaaaggctctgaagagttccgcgaccggaacctcaacgacacccgatacataagccgcttcttcaagaactatgtagaaaggttcctaaaactagccgaagaatcagaagaacgaacctgcgtagtactctcggggcagctcaccgcattccttcgagcacgatgggggctcgcgaaagtccgaggcgacagcgacagacaccatgccttagacgccgcagtaatcgccgcatgcagccgatcaatggtaaaaagactatccgattacgcgcgcaggcacgaactagaaaaagtgcgaacaggcttcgtcgacttcgagacaggcgagatagtcgacgcaggaaaataccgccaaatagagcgagacttcccaagcccctggccatacttcagagatgaactactcacgcgactaaacacggatgaccccgcggaattgcgagagcgaatgcaatcactaggaagttatcctcccgaagcactcgagaccctacgcccaatgttcgttagccgcgcaccccaacggagaaacggaggagcggcccacaaagacactatatacagacagacagaacgactgaagaaagtaggcagcgtcacgcaaaaggtacccctggcagccttgaacctacgtgatctggagaacctagtagacccccacagaaatgaaaaactctacgccgcaatacgggccaggctcgaagcccacggcggcaaaggagaaaaggcattcccgccgaacaaccctctacgtaagcccgatcgtgacggaaatccaacaggcccaattgtacgcactgtaacgcttgtgatcgacaaaatgagcggaatccccgtaaggggaggagtcgccaaaaatgatacaatgctccgagtggacatcttcagaagcaagaaagatggaaaatttcacctagtacccttgtacgtacaccatgcagtagcaaagcagctcccaacgcgcgcagtcatagcttacaaggacgaaggagaatggaccccaatcaacaaccacgacttcgacttcctctttgccctataccccaacgacctagtccgcatcacccttaaaaaggagcggcactttggatactacgcgggatgtaaccgggcaaccggcgccgtatcaatctgggcacacgaccgcaaccagagaataggcaaggacggattcatagacggaatcggggtcaaaacggcgctatcagtcgaaaaattccacgtggacacactcggaaacgtctaccccgccccaccagaaacaagaagaggcctcgcctga

SEQ ID NO: 7413 - RNA, 3357 nt, synthetic construct
  misc_feature 1..3357: note = Cas9 variant
  source 1..3357: mol_type = other RNA
atggggaccaggtactctttcgacatcggaaccaacagcatcggctgggccgtctggagaacaggcagagacccgaaggggattttcggcgaaaaggacgccccgctcgaactactaggcgctggcgtacgcctgttcaaggatggccgaaatcccaaagacgggcaatcccttgccacaatgaggaggatcccgaggcaggcccgcaaaagaagggaccgattcgtcctacggcgggaagcactcgtagccgcactcatcgaggccggtctaatgccagcttcagagaaagagcggaaagcgctggccgacctcgacccttaccaactacgagccgcaggacttgataaagccctcgcaccgcacgaactaggacgagcaatattccacctacaccagcgcaggggcttcaagagtaaccgcaaaacggaccgaaagtcggacgatcgggacaaaggcaaaatcgcaacagccagtgccgcgctagctaagaaattcgaagacgaaaacgcaagaacatttggagagttcctatggaggagacacagggaccccgatatgaaacgacaagcagtcctcaaggcacacgaccccgctaaaggcaagcccgacctacgagcagcgaaacttagacaacccacaaggatacgactggaaggccagggagccacagcactgtacgagttctacccaacacgcgaaatgctatgccacgagttcgacgcactatgggaggcccaggctcgacaccacccaatgctgctaacaagagaagcaggagacaaaatccgatcgatactcttccggcaaagagagctcaaaccacccctaataggcctatgcaccttcgaatacgcagccggagaaaaggaaagcagactacccaaagcgctaccaagcgtacaagcaagagaaatctacgaaaggcttggacacatacggttaagcacagggagcggcacagaccgcccactcaaaagctccgaaagagacgacctcgcgaccgcactcctacactgcggcctcacgaagataaaagtatcaaagacaaaaggactggcattcaaaacagagttcagaaaagcactccgattgggtggcgaagtcagaataaactttgaagagatgggcgaagagggtctagtggacctcagaaccaacagactactcgtccaagacgaccactacggaccacgatggcgcgcccttagctggtccggaaaagacgccttcgtgaagaaactcctagaggcgacggacgacgacaagctagtagcacgactaatgacagaggatggactgtcagcagtccaagcacgaaacgcagcgagcatcccactacccgacggctatagtcgactcggacccaccgccaacgccgcgatcctgcaagcactgatagacagcagagacgagaacggatttgtcgtgacttacgacaaagcagtacggagagcaggggagagactcggcaaagactggcaccactcagacgaaagagacggagaaatcctagacgccctaccgtactacggaaaagtactacaaagacacatcctccccgggatgatggaccccgcggatcgcaaagacgaagcaaaattttacggacgaatcatgaatcccagtgtacacatcggattgaaccagctgcgaaggctagtaaacgccctaatcgagaggtttggaccgccagaccaaatcgtcgtcgaactggcaagagacctaaaaatgtctgcaagggagaaagaacaagaacagagaagaaacagagacaaccgagaagccaacgaaaagcgaacgaaaaagctagtggaactaggtcaagacaacaatggcgaaaaccgggcaagactcaaactatacgacgaacaacaacgagcaggcaacggagtagcccactgccccttcacactagacccaatcggcatcactcaactcttcagcccagaaatcgaaatcgaacacgtactacccaggagtagaacactagacgactctgccgcaaacaaggtattatgcttccgaacaataaacagaataaagcgaggaaaaaccccatgggaagcatttcacgcggatccgaaatggccagacatcgcagccaacgccgaaaaacttcctccaaacaagagatggagattccgagaggatgctatggatgtgttcgaagcaagaacaagcgggaaaatggacaagacaaccttggaacagatggggctaacaacaggcttccaagctcgccacctaaacgaaacaaaacacatgagcagactagctaaggcgtacctaggaaaaatatgcgaccccgacgccgtgtacgtaacaccaggcgccctcacaagtctgttacggggtaaatggggcctgaactcaatcctcagcgacgacaacctcaaggacagaacagaccaccggcaccacgcaatcgacgccatcacaataggagcaatgacacgatccctactactcgaactgaacaccctagcagggaaggccgaacaaagcgactatgacgacgtggtgggcaaagtaccctggccatttgacaacttccgagacgcggtacgaagtgtcgtagacagagtcgttgtcagtaataaacccgaacacggcaagcagggcgcactccacgaggacacagcatacggaatagtaggagatgaagcggaggcagaggaaatcgggaacttagtaaggcgcaaactattagtagacctcacacccggagaggtagacagaattagggacgccggcctgcgcaaggcgatgcaagcagcggtcgcgcccagccgtgacgccaggggcaaggtatcagacgcaaaagggttcgcagcagcactagacacgttcgccaaagcacaaggtatgagaagaatcagagtcggcaaggaagacatgagcgcagtaaccatccacgaccgccaaacggacaaagcgtataaagccgtcgcaccgggcgaaaaccaccacgttgacgtcgtccaaatgcgcgacggcgcatggaaaggattcgctgtaaccgtattcgaagcgaaccaaaaggattttagaccacaatgggaaagagagaaactaggaggaaagctagtcatgcgactccacaaaggtgacgcggtagagctggagagcagcggggtaaggctcgtgaaattcgtgcaacaaatatggatgaaaagcaacctggtactactaaccgagcacaacgaaggaggggacctgcaaaaacgacaccaagatgcagacgacccattccgctgggacttcgcaaacatagggaaactaaaagaacgcggatgcgtggcggtcaaagtagacgagctcggaagagtgacaaaacgaatatcaaatacgtga

SEQ ID NO: 7414 - RNA, 3360 nt, synthetic construct
  misc_feature 1..3360: note = Cas9 variant
  source 1..3360: mol_type = other RNA
atgggctacagaataggtctcgacgtaggcatcacatcgaccggctacgccgttcttaaaaccgataaaaacggcctgccgtataaaatattaactttagactccgtaatttacccgcgcgcggagaatcctcagaccggagcatcactcgcagaacctcggcgaatcaaaaggggacttagaagacgcacacgccgcacaaaattccgcaaacaaagaacgcagcaactcttcatccactcaggcctgctatcaaaaccagagatagaacagatactagccacgcctcaagcaaaatacagcgtgtatgaattaagagtcgcaggactagaccgccgcctcaccaactccgaactgttccgcgtactctacttcttcatcggccaccgcggcttcaaatccaatcgaaaagctgaactgaaccccgaaaacgaagcagacaagaaacaaatgggccagctgctaaactcaatcgaggaaatacgcaaagcaatcgcagaaaaaggctaccgaacggtcggcgagctatacctcaaagatcctaaatacaacgaccacaaacgtaacaaaggatacatcgacgggtacctcagcacacctaaccgccaaatgctggtcgacgaaataaagcaaatactggacaaacaacgagaattaggaaacgagaagctcaccgacgagttctacgccacgtacctactcggcgatgaaaaccgagcaggcatcttccaggcccaacgagactttgatgaaggcccgggcgcggggccatacgccggagaccaaatcaagaaaatggtcggaaaagacatcttcgaacccacagaagaccgagctgcaaaagcaacctacaccttccagtacttcaacctacttcagaaaatgacctcactcaactatcaaaacacaacaggagatacttggcacaccctcaacggactcgaccgacaggccatcatcgatgccgtctttgcgaaggctgaaaaacccacgaaaacctacaagcccaccgacttcggcgaactccggaaactccttaaactcccggacgacgcaaggttcaacctagtcaactacggaagcctccaaacacaaaaagagatagaaactgtggagaagaaaaccaggttcgtcgactttaaagcctaccacgacctggtaaaagtcctcccagaagagatgtggcagagccggcaacttctggaccacataggcaccgccctaaccctctacagctcagacaagcggcgccgcagatacttcgccgaagaactcaacctccccgccgagttaatcgaaaagctgctccccctgaatttctcaaaattcggtcacctatccataaaaagcatgcaaaacataataccttacctagagatgggccaagtctacagcgaagcaacaacaaacacaggatacgattttcgcaagaagcaaatctcaaaagacacaatacgggaggaaatcactaatcctgtagtccgacgagcagtcaccaaaaccatcaaaatcgtcgaacagataatacgccgctacggtaaacccgacggcatcaacatagaacttgcgcgcgagctgggccgcaacttcaaagaaagaggcgacatacaaaaacgccaagacaagaaccgccagacaaacgataaaatagccgccgagctcaccgagctcgggatcccagtcaacgggcaaaacatcatacgctacaaactccacaaagaacaaaatggtgtcgacccgtacaccggggaccaaatcccattcgaacgtgccttcagcgagggatatgaagtggaccacataatcccatattcaatatcctgggacgatagctacacaaacaaagttctaacaagcgccaaatgcaaccgagaaaaaggcaacagaatacccatggtatacctagccaacaacgagcaacgcctaaacgcactgacaaacatagcggacaacattatcagaaattcccgaaaacggcaaaagctactcaaacaaaaactctcagacgaagaactgaaagactggaagcaacgcaacataaacgacacgcgcttcataacacgagtcctatacaactacttccgacaagcaattgagttcaatcccgaactcgaaaagaaacaacgagtactccccctgaacggggaagtcaccagcaaaatcaggagccgctggggcttcctcaaagtacgagaggacggcgacctccaccacgcaatagacgccaccgtcatcgcggcaataaccccaaaattcatccagcaggtcactaaatattcacaacaccaggaagtgaaaaacaaccaggccctatggcacgatgcagaaattaaagatgccgaatacgcagccgaagcccaacggatggacgcggacctattcaacaaaatattcaacggattccccctaccctggcccgagttcctagacgaactactggcacgcatatccgacaaccccgtcgaaatgatgaaatcacggtcctggaacacatacaccccaatcgaaatcgcaaaactcaaacccgtattcgtcgtacgcctagccaaccacaaaatatccggacccgcccacctcgacaccatccgaagcgccaaactattcgacgaaaaaggcatagttctcagtagagtcagtatcacaaaactcaaaatcaacaagaaaggacaggtagccaccggcgacggcatatatgaccccgaaaactccaacaacggcgacaaagtcgtgtactccgccatccgacaagcattagaagcacataacggatcaggagaactggcattcccagacggatacctcgaatacgtcgaccacggaacaaagaaactcgtcagaaaagttcgcgtcgcaaagaaagtctcgctacctgtccgactgaaaaacaaagccgccgcagacaacgggagcatggtccgcatagatgtattcaacaccggcaagaaattcgtattcgtcccaatctacataaaagacaccgtcgaacaagtactaccaaacaaagcaattgcaagaggcaaatccctgtggtaccaaataaccgaaagcgaccaattctgcttctcgttgtaccccggggacatggtgcacatagaaagcaaaacaggaattaaacccaaatactcgaacaaagaaaacaacacctcggtcgtaccgattaaaaatttctacggatacttcgatggtgcggacatagcaacggccagcatcctggtgcgcgcccacgactcctcctataccgcccgtagcatcgggatcgccggccttctcaaattcgaaaaataccaggtggactacttcggacgctaccacaaagtacatgaaaagaaaaggcagctattcgtaaaacgcgacgaatga

SEQ ID NO: 7415 - RNA, 3360 nt, synthetic construct
  misc_feature 1..3360: note = Cas9 variant
  source 1..3360: mol_type = other RNA
atgaacgacaagaaaaacctaggccccctaacattcgggtttgacataggaatcgcatcagtcggctgggccgtcctctcaccaacccgcatagtggacttaggggtccgctgcttcgacaaagccgagaccgcgaaagagggagaaagcctcaatctagcaagaaggtcagcacgcctgatgcggcgaaggctgcgtagacgagcctggagactcataaagttagcgcgactcctaaagcatgaaggactaatagccgacacgaaaactttcatccaaccaagcgcctcacacgcgtccccctggcaactcagaaaggacggcctagaccgcgcactctcacccgaagaatgggcaagagttctctaccacctctgtaaacacagaggattccactgggtgagccgcgccgaggcgagaaaagcggacggagacacaaaaggtgaagggggaaaagtaaagcaaggcctcgcgagcacgacaaaactcatgaacgacaaaagctacagaacagccgcagaaatggtactggcagagttccccagcgcgcaacgaaacaaaagaggggaatacacaaaagccctctcacgagaactgctagacaacgaactaaaacaactattcgaacgacaacgagaatacggcaacccacacgccgacaccaatctggaagccaaaatccgaggcagcggcgaccacaagtcagggctattctgggaacaaaaaccagcactaagcggaaacgacttgctaaaaatgctagggaagtgcacattcgaaaagcaagaataccgagccccgaaggcatcgtttacagcagaaagacacgtctggctaacccggctaaacaacctaagaatcatagttgacggacgcacgcggccactggccgacgccgaaagaacgatggcgctctcactcccctacgaacaagtcggggactttacctataaacaactaagagcggcactggtaaaagccggactaatgcccgactccttcaagtttgcaagcctagcttacccgtcagagttccaaaaagccgaagggaaagcaaaagaccccgaaagcgccgccctaacaaaactagcggcctggcaagagctaagagcaaccctaaagaaagccgacctcgagagcgagtggcaacaaatatcatgcgcagcactagagggacagccagaaacactcgacgaaatcgccggagtcctcagcgtcttcaaagacgacgacgaagtcctcaacgaactacaaaagctcggactccccggaggggcaaaaacagaaaacgcactgctcgacatcagattcgacaagttccacgcactgagcttaaaggcactacgaaagatcgtaccgtacatggaacgaggactacggtacgacgaagcctgcgaacgggcagaataccaccactcccaactgcacaaagtaggcgaaggcaaccgcaaatacctaccgcccctatacaagagcagagacaaagacggacgcatggttttcaacgacgaactaggagacataccaagaaaccccgtggtcctccgaagcctcaaccaagcccgcaaggtactaaacgccttaatcgcacgatacggatcaccatcaagcgtacacatagagatggcccgcgagctcagcaagccattcgacgagaggatgaaggtcggaaaagaacaggaagcgtaccgggaaaggaatgaaaaagacaaacaaactttcgtggcggagttcggcatagtgggcgccgcgaagggcggagagtttgagaagtggaagctgtacagagaacaacagggcaagtgcgcctatagtatacaggggatagacctaaaccgcctactcgaaccgggatatgttgaaatcgaccatgcactaccatattcacgcagcttcgatgattcaaagtcaaacaaagtcctagtgctggccgcagaaaataggaacaaaggaaacaggaccccatacgagtacctagatggggaacacaactcagagcgctggcgacaattcgtcggattcgtagagagcaacaaactgtaccgccaagcaaaaaggagcagactactcaggaaagacttcggcaaggaacaagccgacgaatttagagagcgtaacctaaacgacacccgctacgtctgtcgattcttcaaaaaccaggtggaacaattcctgaaactagccgaaggctcggaaagcaaacgctgtgtcgtcctaagcggacaactcacagcattcctgcgcgcacgctggggattaatcaaagtgagagacgaatccgaccgacaccacgcactcgacgcggtagtcgtagccgcctgcacccacggaatggtaaagcgcatgagcgactacgcaagacggaaggagctcgaccaagtcgcggaaggattcgtagacgtagaaacaggggaaatcatcaacgcggccatgtttcaacaactacacgaacacttccccgacccatggccccacttccgcgacgaagttcaaatgagactgaagatcgacgacccagcccaactgcgaagtgacctactcagactcggcaattacgccgaagaagacgtgcacgcagtgagaccactgtttgtatcacgagccccacaacgaagaaactccggagcagcccacaaagaaaccatctacggccaaccagagagattgaaggcacaaggaggagtaaccgagaaagtagcactcacagccctcacgatgaaagacctagaccgacttatagacccacaccgcaatgaaaaactatacgccgcgatccgcaagagactcgaagagtttggcggaaaagcggacaaggcattcgccgctagcaacccacttcacaaaccggacaaggaaggcaacccaacaggacccatcgtacgcacagtaaccctcgaaatagacaaactaagcggagtcccagtacgaggaggcatcgccaaaaatgacacaatgctccgcgtcgacgtattcacgaaagcaggcaagttccacctagtaccagtatacgtacaccacaaggtgacaggcctccccaacagggctatcgtagcgagcaaggacgaagacgaatggactgcgattgacgacagttttgagttcctattcagcctgtacccaaacgacctagtcaccatcacacagaaaggaaaggccccggtccgcggctattacgcaagctgtcaccggggcacaggagcattctccctatgggcgcacgaccgagcaagctcagtcggcaaaggaggccagatagaagggataggcattaaaacagcactcgctgtccaaaagtacaatgtggacgtccttggcacaacatacgccgccccgctggaacaaagaaggggtctagcctga

SEQ ID NO: 7416 - RNA, 3363 nt, synthetic construct
  misc_feature 1..3363: note = Cas9 variant
  source 1..3363: mol_type = other RNA
atgcgcaaggtgaccattggtttcgacatcggggtcagctccgtgggatggagtgtggtagatatgaacaatggggccatcgtggagaccggcgtgcggctgttctcggctagttccgcggagaacaacgtcgagagacggaacaaccgtcagacgcggcgcctcaaccggcgtcggaagaaccgcttgaaagacgtgaagtacctgctcgagaccaaccacttcaccttcgaccaggagcaggggaccaacccctacgagctgcgggtggccggcctgcaccgcaagctcacgcggagcgagctggctcgcgccctgtaccacttggtcaagcggcgcggcatctcctacgacctgaccgacatcgaggaggaagagatcgtaaccaccagcgcatacaagacggcgctggggaagaaccagtcccaactcgccgagaagaccccgggcgagatccagttcgctcggctggagaactacgggaaggtccgcggcagcattgaaataaacgagcaggacatcctgctcaacatcttccccacctcggcctacctgaacgaggcgaagcggatcctggccacccagcgcaagttttaccccgagatcacggaggccttcatagagaagtactgcaccatcctcacgcggaaaagagagtactacgtcggtcccggcaccgagaaaaatcgcactgactacggaatctaccgaaccaacggggagaccctagacaacctgttcgaaatactaatcggcaaggacaagttctacccgaacgaggaacgcgccgccgggaacagctacaccgcgcaactgttcaacttcgtgaacgacctaaacaacctcaagatccagacgattgaggaccagaagctaacccccaagcaaaaggaggagattatcgagcaggtcaagaccgccgagaagaaggtctccctgattcagctcatcagcaagatcaccaagacgcccaaggaccagatcaccggctaccggaccgacaagaacgggaaacccgacctgcactccatggccgtgttccgcaaggttagaaagcagttcctgaccatggagatcgacatcctccactggccggacgagctgctgaacgacctcgggcgcctgctgacgctcaacaccgaaaagggcgagatccggaagcaactgaccaaggacttcatgaagcgctaccccatcctgaacgagcagctcgtcgaccagatcatcgagaaccggcacatcttcgctgtaagcgggaaccacaaatggcaccgcttctccctgcggacgatgaacgagctgcttcccgagatgctagcgacgagcaaggaacagatgaccctactctccgagcgcggcatgattaagcagcataagcgggactacttgaagatgaacgagctagacgcgcgcctcatcagcgaggagatctacaaccccgtggtcggcaagagcgtgcgggaagccatcaagctgttcaacgagttaatgaagaagtaccaggaggtgcgctacgtcgtgctggagatgccgcgagacgacaacgaagagaaggccaagaaggagctccaaaagtaccagaaggagaacgagaatgagaaggagatcgccctgtccgagttccagcgcaagggcttcttctccgacgcgcagctggagcgggcgctcatcaaggaccgcaagttgaagactaagatccgcttctggcaccagcaagagggcaagtgcctgtactccgggcagatcattacccccgtcgagctcctgacgaacagcttctccttcgacatcgaccatattatcccccagagcgtgtctttcgacgatagcttaaacaacaaggtgttatgcaccaaggagatgaacgatcagaagggcaagcagaccccctacgggtttctgcttaacggcaacgggcagggcttcgaccggtttaaggccatggtcaacgccaaccgcctcatgtccaagggcaagaagaaaaacctgctgttcatggaggacctcaacaacatcgagacccgtaagcggttcatcgctcgaaaccttgtggacacccgctacgccagccgggttgtgctgaacgagatacaacaatacctccgcgcgaaaaacaaagacacccaggtggccgtggtccgtgggaagttcacggccaccctgcgcaagcactggaacatcaacaagtcccgggagacccaccaccaccacgccctggacgctagcatcatcgccatcacgccgctcctctccgtgtggaagaagaagcagacgctgatccctaagaccttgagcgaggaaaagctggagttcgagtacgacgacatagtggaggatactatcttcgagaaggcgctgtaccagctccccaaggagaacttcaaggaacagctgaacaatagtcagcccaatatcaaattctcataccaggtcgacaagaagatgaaccgcaaggtgagtgacgccacaatctacagcgtgaagcaggcaaagctgtccagcgacaaacagagcgaagagtacgtgctcgcgaagatcaaggacatttactccgttgagggctacaaaacattcgctaagatctatgagaaggataagagcaagttcctgatggcccagaacgacccgaagaccttcgagaagctggaggagatcatccagtcgtacccgagcacccgggagatcatagtgggggagaaggtcaaggttgtggacgtctcccccttcgagctctaccgtaaggagtacggctacatcacgaagtacgccaagaaaaacaatgggcccatcatccggcagctgaaatactacgaccacaaaatcggcatgcacctcgacatcaccaaccagaagaacaacggcaaggggaagaaagtgatcctccagcaactcaagagctggcgcaccgacgtgtactacaaccacgagaagcaggagtacgaaatcatgggcctgaagtacagcgacctgcggttcaagaaggaccaatatgggatcccgaaggagagataccaggaggtcaagcagatggagaagatcgcgccacagagcgagttttgtttctccctgtatcggaacgaccgcatcaaggtgctgaacaaggagaccgacgaagaggtggagctcctgttcggcgcccggaactacacaagcgccggctacgtcgacctgaaaccaatcgaccgcgtcgagttcgggaagaaagaatggatccccgtgtaccagtacgccacctctgacggcaagtgcaagaagaagttcgctaagaaggggtatgaaatctacaaggtcaacaccacgatcctcggcgagagttactacatcaagaaggagcgcatgctaccgaaaaatatcctggactga

SEQ ID NO: 7417 - RNA, 3363 nt, synthetic construct
  misc_feature 1..3363: note = Cas9 variant
  source 1..3363: mol_type = other RNA
atgagcgacctggtgctcggcctggacatcgggatcggctccgtcggggtgggcatcctgaacaaggtgaccggggagatcatccacaagaacagccgcatattccccgccgcccaggcggagaacaacctggtgcggcgcaccaaccggcagggccgccggctgacgcgccggaagaagcaccgccgggtgcgcctgaaccgcctcttcgaggagatcggcctgatcaccgacttcaccaagatctccatcaacctgaacccgtaccagctccgggtgaaggggctgaccgacgagctgagcaacgaggaactgttcatcgccctgaaaaacatggtcaagcaccggggcatctcctacctggacgacgccagcgacgacgggaactccagcgtgggcgactacgcccagatcgtgaaggagaactccaagcagctcgagacgaagacgccagggcaaatccagctggagcgctaccagacctacggccagctgcggggcgacttcaccgtcgagaaggacgggaagaagcaccgcctcatcaacgtgttccccacgagcgcctaccggtccgaggcgctgcgcatcctgcagacccagcaggagttcaacccccagatcaccgacgagttcatcaaccggtacctcgagatccttaccggcaagcgcaagtactaccacgggccgggcaacgagaagtcccggacggactacggccgctaccgcaccagcggggagaccctggacaacatcttcggaatcctcatcgggaagtgcaccttctaccccgacgagttccgggccgccaaggccagctacacggcgcaggagttcaacctgctgaacgacctcaacaacctgaccgtgcccaccgaaaccaagaagctgtccaaggagcagaaaaaccagatcatcaactacgtcaagaacgaaaaggccatgggccccgccaagctgttcaagtacatagccaaattgttgagctgcgacgtggccgatatcaaggggtaccgcatcgacaagtccggcaaggcggagatccacacgttcgaggcctaccggaagatgaagaccctcgagaccctggacatcgagcagatggaccgcgagaccctggacaagctcgcctacgtgctaacgctgaacaccgagcgggagggcatccaggaggccctcgagcacgagttcgccgatgggagcttttcccagaagcaggtcgacgagctcgtgcagttccgcaaggcgaacagcagcatcttcggcaaggggtggcacaacttctccgtgaagctgatgatggagctcatcccggagctgtacgagacaagcgaggagcagatgaccatcctgactcggctcggcaagcagaagacgacctccagctccaacaagaccaagtacatcgacgagaagctgctgacagaggagatctacaaccccgtggtggccaagagcgtgcgccaggccatcaagatcgtcaacgccgccattaaggagtacggggacttcgacaacatcgtgatcgagatggcgcgggaaaccaacgaggacgacgagaagaaggccatccagaagatacagaaggccaacaaggacgagaaggacgccgccatgctcaaggcggccaaccagtacaacggcaaggccgagctgccccattccgtgttccacggccacaagcagctggccaccaagatccgcctatggcaccagcagggggagcggtgcctctacaccggcaagacgatctccatacacgacctgatcaacaaccccaaccagttcgaggtcgaccacatcctgccgctctccatcacctttgatgacagcctggcgaacaaggtgctggtctacgctaccgccaaccaggagaaggggcagcgcaccccctaccaggcgctcgactccatggacgacgcgtggagcttccgggaactgaaggcgttcgtgcgcgaatccaagaccctgagcaacaagaagaaggagtacctactcacggaggaggacatctccaagttcgacgtgcggaagaagttcatagagcgcaacctggtcgacacccgctacgccagccgcgtggtgctcaacgccctgcaggagcacttccgggcccacaagatcgacaccaaagtcagcgtggttcgcggccagttcactagccagctgcgcaggcactgggggatcgagaaaacgcgcgacacctaccaccaccacgccgtcgacgcgctcatcatcgccgcctccagccagctgaacttatggaagaagcagaagaacaccctcgtgagctactccgaggaccagctgctggacatcgagaccggcgagctcataagcgacgacgagtacaaggaatccgtgttcaaggccccctaccagcacttcgtcgacacgctcaagagcaaggagttcgaggactccatcctgttcagctaccaggtggactccaagttcaaccggaagatcagcgacgccaccatctacgcgacccgccaggccaaggtgggcaaggacaaggccgacgagacctacgtcctcgggaagatcaaggacatctacacgcaggacggctacgacgccttcatgaagatctacaagaaggacaagtcgaagttcctgatgtaccggcacgacccccagaccttcgagaaggtgatcgagccgatcctggagaactaccccaacaagcagatgaacgagaaggggaaggaggtgccctgcaaccccttcctcaagtacaaggaggagcacggctacatccgcaagtacagcaagaagggcaacgggcccgagatcaagtccctgaagtactatgacagcaagctgggcaaccacatcgatatcacccccaaggactccaacaacaaggtcgttctccagagcctgaagccctggcggactgacgtgtacttcaacaagaacacggggaagtacgagatcctgggcctcaagtactccgacatgcagttcgagaaggggaccggcaagtacagcatctccaaggagcagtacgagaacatcaaggtccgcgagggcgttgacgagaatagcgagttcaagttcaccctgtataagaacgacctgctcctgttgaaggacagcgagaacggggagcagatcctcctgcggttcacctcccgcaatgacacgagcaagcactacgtggagctgaaaccgtacaaccggcagaagttcgagggctcagagtacctcatcaagagcctggggactgtcgtgaagggcgggcgctgcatcaagggcctgggcaagtccaacatcagcatctacaaggtgcggaccgacgtcctcgggaaccagcatatcatcaagaacgagggcgacaagcccaagctggacttctga

SEQ ID NO: 7418 - RNA, 3363 nt, synthetic construct
  misc_feature 1..3363: note = Cas9 variant
  source 1..3363: mol_type = other RNA
atgggcctggacatcggggtggccagcgtcggcttctccgtgctcgacatcgacaaggggaaggtgatcgagctgggcgcccgcctgttcagcgcgactgtcgccgccgggaaccaggaccggcgcgacatgcggggcgcccgccggctcctgaaccgcaacaagcagcggcgccaggacaccggcaaactgttcaagaagttcgggctcatcgacgacttcgacaagggctccttctacgacaacttcaaccagaacctgaacccctacgagctgcgggtgaaggggctcacggagcagctgaccaaggaggagctggccgagagcctctaccagatcgtgaagcaccgcggcatctcctacgcgctgaaggacgccgacgtcgacgagggcggaaccgactacagcgtgtccctgaagatcaacagccaggagctcgccgagaagaccccggcccagatccagctgcagcggctgaacgactacggcaaggtgcgcgggcaagtcgtgatcggcgacgaccccgacaaccagaaggtgctcctgaacgtcttccccacgtccgcgtacgagaaggaggccaagcagatcatcgccacccaacagcagttctaccccgagagcctgaccgacaagttcaccgaggagtactgccagatcctcacgcggaagcgcgactacttcgtggggccgggcaacgagaagtcccggaccgactacggcatctacaagaccgacgggcgcaccctggacaacctgttcgaggagctcatcggccacgacaagatctaccccgaggagcttcgggcctccgccgcgtcctacacggcccagctgttcaacgtgctcaacgacctgaacaacctgcgcatcctcaactacgaggatgggaagctgaccaaggaggacaaagagaagatcatcgccgagatcaagaacaacaccaccacgatcaacatgctgaacgtcatcaagaaggtggccggctgctctaaggacgacattaaggggttccgggtgaacgaaaaggacaagcccgagatctccagcatgccggtctaccgcaagatccacaaggacctcctaaaggccggcgtggacatctccgactggccggtggagttcatcgacgaactgagcttcatcctcaccctgaacaccgagaacggcgagatccggaagcagctcaacaaccgcctcgcgcccaagttcgacttcctgaacgccgacctgatccaactcatcatcgacaacaaggacagcttcgagatcaagaccaacaacaagtggcaccgcttcagcgtcaagacgatgaacaagctgatccccgagatgatggagcgccccgtggagcagatgaccctgctgaacgagatggggctggtgaagaaggacaagaagcgcttcgagaacaacaagtacctgccatacaaggagatcgccaaggacatcttcaaccccgtagccagcaagtccgtgcgggaggccctcaagatcgtcaacgccgtgctgaaaaagtacggccacatcgactacctggtggtcgagatgccccgcgacaaaaatctgaaagaggagcaggacaacatcaaggagttccagaataagaacaagaaagccaaggacgccgccttcgaggccttcgtcaaaagcgtggggtccgagcagcgggtgaaggaggcgctcagcaagaaccgcaagctccagatgaagatgcggctgtggtaccaacagcaggagatcgacccctacaatggcaagaccatcgacgccaccgacctaatcaacaacccggacaagtttgagatcgaccacatcatcccccagtccatcagcttctatgactccatcaacaacaagacgctgtgcttcgccagcatgaaccaggtgaaggggcagaagaccccctacgagttcatgctggagggccacggccagtcctacgacaagttcaaggccaccgtgatggcgaacaagaactttgggaaggccaagcgcgccaattacctcttcgaggagaacgtcagcgacatcgagacccggaagcgcttcctgtcccggaacctggtggacacgcgctacagctcccgggtggttctcaacagcctgcaggacttcttccgcgagaagtccgccgacaccaaggtgaccgtgatccggggcaagttcaccagcaacatgcgcaagcactggcacatcgacaagacgcgggagaccttccatcatcacgccatcgacgcgtccatcatcgccgccacccccttcctgcgcatgtggaagaagggcgggaccatcttcccggtcaaggtgggagaggagagcatcgacatcgagacgggagagatactcgacgacaagaacttcgacaaggccatgtacgaggagccctattccggcttcgtgagcgagatcatgaacgccgacgaccggatcaagttcagccaccaggtcgacaagaagatgaaccgcaaggtgtccgacgcgaccatctacagcacccgcaccgggaagctggccaaggacaagaaggacgccgagtacatcgtggccaaggtcaaggacatctactccgtggacggcttcaagaagttcaagaaggtgtacgacaaggacaagaccaagttcctgctctacaagtacgacccacggacgttcagcaagctggagcgcatcatctccgactgccccgacaaggtcgagaaggtgcagaccaacgggaaggtgaaggccgtcgacatcagcccgttcgagatgtaccggcgcgaccacggcatgatcaagaagtattccaagaagggcaacgggcccgcgatcaagcagctgaagtacctcgacaagaagctgggcagccacatcgacatcacccccgccaacgccaatgggaagcacgtgatcctgcagtccttaaagccctggcggaccgacgtgtacctgaaccacgagaccggcgagtatgagatcatggggatcaaatacagcgacctgaagttcaacaagaacgagggctacggcatcaagaaggacaagtacctcgagatcaagaaggtcgaggaggtgtccgagaagtccgagttcatgtttagcctgtaccgcaaggaccgggtgaaggtccaggacatgaagaccggggagagcgtggagctcctgttctggtcccgcaacttcagcaacaagaagtatgcggagctgaagccgatctcccaggcggagaacgacaagaagctgcccgtgtatggtaaggggcggctcatcaagcgcctgatccccaagaactgcaagatctggaaggtcaacaccaccatcctgggcgacccgtactacctcgagaaggagagcgacagccccaaggacatcctggactga

SEQ ID NO: 7419 - RNA, 3366 nt, synthetic construct
  misc_feature 1..3366: note = Cas9 variant
  source 1..3366: mol_type = other RNA
atgagcgacctggtgctcggcctagacatagggataggctcagtcggggttggcatcctgaacaaggtgaccggtgaaatcatacacaagaacagccgcatctttccagccgcgcaagccgagaacaatctcgtcaggagaaccaacagacaaggccgcaggctgactagaaggaagaagcaccgccgagtgcgcctaaatcgcctcttcgaggaatccggcctgatcaccgacttcacaaaaatcagcattaatctgaacccctaccagctccgggtgaaaggtctgacggacgagctttccaacgaggagctgttcatcgccctgaaaaatatggtcaagcaccggggcatcagctatctggacgacgcctccgacgacggaaactctagtatcggtgactacgcccagatcgtgaaggagaacagcaagcaactcgaaacgaagaccccgggacagatacagctggagcgctaccagacatacggccaactgcgcggagacttcaccgtggagaaggacgggaagaagcaccgcctcattaatgtctttcccacgtccgcctaccggagcgaagcgctacgcatccttcaaacccagcaggagttcaacccccaaattactgacgaatttgtgaatcggtacttagagatcctgactgggaaacggaagtactaccacgggccgggtaacgaaaagtcccggacggattatggcagataccgcacgaacggggaaaccctggacaacatcttcggcatcctcatcggcaagtgcaccttttaccccgatgagttccgggccgccaaggccagctacacggcacaggagttcaacctcctgaacgacctcaacaacctcacggtgccgaccgagaccaagaagctgtccaaggagcagaagaatcaaatcatcaattacgttaagaacgaaaaggctatgggaccagcaaagctgtttaagtacatcgccaaactcctgagctgcgacgtggccgacatcaagggttaccgcatcgataagagcggcaaggcggagatccacacgttcgaggcatatcgtaagatgaagaccctcgagaccctggatattgagcagatggacagggagactctggacaagctcgcatacgtgctaacgctaaacacagagagagagggaatccaagaggctctcgagcatgagtttgccgacgggtccttctctcagaaacaggtggacgagctggtccagttccgaaaagctaattctagcatcttcggcaaaggttggcacaacttcagtgtgaaactgatgatggaactcatcccggagctgtacgagacctccgaggagcaaatgaccatcctgacgcggctcggcaagcagaagaccacctccagctccaacaagaccaagtacatcgacgaaaagctgctgacggaggagatctacaaccctgttgtcgccaagagcgtgcgccaggccatcaagatagtgaacgctgcgatcaaggaatacggggacttcgacaacatcgtgatcgagatggctcgggagaccaacgaggacgacgagaagaaggccatccagaagatccagaaggccaacaaggacgagaaggacgccgcaatgctcaaggcggccaatcagtacaatggcaaggccgaactgccccactccgtattccacggccacaagcagctagcaactaagatccgcctgtggcaccagcagggggagagatgcctctacaccggaaagactatcagcatccacgacctgatcaataactcaaaccagttcgaagtcgaccacatcctacccctcagcatcaccttcgacgacagcctggctaacaaggtgctggtatacgcaaccgccaaccaagagaaggggcagagaaccccgtaccaggccttagattcaatggacgacgcctggtccttccgggagctgaaggcgtttgttcgcgagtcaaagaccctgtccaataagaagaaggagtatcttctgacggaggaagacatcagcaagtttgacgtgcgtaagaagttcatcgagcgcaacctagtcgacaccagatacgccagtcgcgtggtgttgaacgccctgcaagagcacttccgggcccacaaaattgacaccaaggtcagcgtggtgcggggccagttcacctcccaactgcgccggcactgggggattgagaagacgcgagacacctaccaccaccacgcggtggatgcgttgatcatcgctgccagcagccagctgaacctgtggaagaagcagaagaataccctcgtgtcctatagcgaagaccaattattggacattgaaaccggggagctcatctcagacgacgagtacaaagagttcgtgttcaaggccccataccaacacttcgtcgacacacttaagtctaaggagttcgaggattccatcttattcagctaccaggtggactccaaattcaaccggaagatcagcgacgcaaccatctacgcgacccgccaggctaaggttggaaaggacaaggccgacgagacctatgtccttgggaaaataaaggacatctacacgcaggacggctacgacgcattcatgaaaatctacaagaaggacaagtccaagttcctgatgtaccggcatgacccccagaccttcgagaaggtgatcgagcccattctggagaactaccccaataaacaaatgaacgagaagggaaaggaggtgccctgcaaccccttcctcaagtacaaggaggagcacggctacatacgtaaatacagcaagaaaggcaacggccccgaaattaaaagtctaaagtactacgacagcaagctgggcaaccatatcgatatcactccgaaggactcaaacaacaaggtcgtgctccagagcgtgtccccctggcgagcggacgtctatttcaacaataccacggggaagtacgaaatcctgggcttgaagtacgccgacctccagttcgagaaggggacaggcacctacaagattagccaagaaaaatacaacgacatcaagaagaaggagggcgtggactccgacagcgagttcaagttcaccttatacaaaaacgacctgctcctcgtcaaagaaacagagaccaaggaacagcagctgttccgcttcctcagccggaccatgcccaagcaaaaacactacgtagagctgaagccctacgacaagcagaaattcgagggcggcgaggcgctgatcaaggtgctaggcaacgtggccaacggagggcagtgcatcaaaggcttgggcaaatcgaatatcagcatctacaaggtcagaaccgatgtattggggaaccagcacatcataaagaacgaaggcgacaagccgaagctcgacttttga

SEQ ID NO: 7420 - RNA, 3366 nt, synthetic construct; identical to SEQ ID NO: 1620
  misc_feature 1..3366: note = Cas9 variant
  source 1..3366: mol_type = other RNA

SEQ ID NO: 7421 - RNA, 3366 nt, synthetic construct
  misc_feature 1..3366: note = Cas9 variant
  source 1..3366: mol_type = other RNA
atgaacggcctggtgctcgggctggacatcggcatcgccagcgtcggggtgggcatcctggagaagaactcagggaagatcatccatgccaactctcgactcttccccgcggccaccgccgacaacaacgtggagcggcgcaagaaccggcaggcccgccggctgaaccgccggaagaagcaccgcggcgtccggttccaggacctgttcgaggactacggccttctgaccgacttctccaaggtgagcatcaacctgaacccgtaccgcctccgggtggacgggctgaaccagcagctgacgaacgaggagctgttcatcgctctcaaaaatatcgtcaagcgccggggcatctcgtacctggacgacgcgagcgaggacgggggcgccgtgtccagcgactacgggaaggccgtggaggagaataggaagctcctggcagagcagacccccggccagatccagctggagcggttcgagaagtacggccaggtccgcggggacttcacggtggtggagaacggcgagaagcggcgcctcatcaacgtcttctccaccagcgcgtaccggaaggaggccgagaagatcctgcgcaagcagcaggagttcaacaaccaaatcacggacgagttcatcgaggactacctgaagatcctcaccggcaagcgaaagtactaccacggccccggcaacgagaagtcccgcaccgactacgggcgcttccggaccgacggcacgaccctggacaacatcttcggggtgctgatcggcaagtgcaccttctaccccaacgagtaccgcgccagcaagtccagctacaccgcccaggagttcaacctcctgaacgacttgaacaacctcacggtgccgaccgagaccaagaagctgtccgaggagcagaagaaggtcatcgtggagtacgccaaggaggcgaagaccctgggggccagcacgctgctgaagtacatcgtgaagatgatcgacgcctccgtcgaccagatcagcggctaccgggtggacgtgaacaacaagcccgagatgcacaccttcgaggtctaccggaagatgcagtccctggagaccatcagcgtgggcgagctcagccggaacgtgctggacgagctggcccacatcctcaccctgaacacggagcgcgaggggatcgaggaggccatcaactccaaactgatgggcgtcttcagccaggaccaggtgctcgagctggtccagttccggaagaataactccagcctgttctccaaggggtggcacaacttcagcctcaagctgatgatggagctgatccccgagctctacgagacgtccgaggaacagatgacaatcctgacccgcctgggcaagcagaagtccaaggagacgagcaagcggaccaagtacatcgacgagaaggagctcaccgaggagatctacaaccccgtggttgccaagagcgtccgccaggcgatcaaaatcatcaacgaggccaccaagaaacacgggatcttcgacaacatcgtgatcgagatggcccgggagaacaacgaagaggacgccaagaaggactacatcaagcgccagaaggcgaaccaggacgagaagaacgccgccatggagaaggccgccttccagtacaacggcaagaaggagctgccgggcaacatcttcaacgggcacaaggagctggcgacgaagatccggctgtggcaccagcagggcgagaagtgcctttacaccgggaagaccatccccatctccgacctgatccacaaccagtacaagtacgaaatcgaccacatcctgcccctcagcctttccttcgacgacagcctgtccaacaaagtgcttgtccacgccaccgccaaccaggagaagggccagcgcacgcccttccaggccctggacagcatggacgacgcgtggtcctaccgggagttcaagagctacgtgaaggacctgaagtcactcagcaacaagaagaaggactacctgctgaccgaggaggacattagcaagatcgaggtgaagcagaagttcatcgagcgcaacctcgtcgacacgcggtactccagccgcgtggtgctgaacgccctgcaggacttttacaagtcccaccagttcgacaccacgatcagcgtcgtccgggggcagtttacctcccagctccgccgcaagtggggcctggagaagtctcgggaaacctaccaccaccacgccgtggatgccctgatcatcgccgcgagcagccagctacgcctgtggaagaagcagaacaacccgctgatcacctacaaggagggccagttcatcgacagccagaccggggagataatcagcctcacggacgacgagtacaaggagctggtcttcaaagccccgtacgaccacttcgtggacaccctgcactccaagaccttcgaggacggcatcctcttcagctaccaggtggactccaagtacaaccggaagatcagcgacgccaccatctacgccacgcgcaaggccaagctggacaaggacaagtccgaggagacctacgtcctggggaagataaaggacatctacagccaggcgggctacgacgccttcattaagatctacaacaaggacaagcggaagttcctcatgtaccacaaggacccccagaccttcgagaaggtgatcgaggaaatcctgcgcacctacccctccaaggagcggaacgacaagaacaaggaggtcccgtgcaaccccttcgagaagtaccgccaggagaacggccccatccggaagtacagcaagaaggggaacggccccgagatcaagtgcctgaagtactacgacaacaagctcgggaattacattgacatcagcccggacggctccgacaaccaggtggtgctgcagagcctaaagccctggcgcacggacgtgtacttcaaccaccagaccaagaagtacgagctcatggggctgaagtactccgacctgagcttcgagaagggctccggcaagtacagcatctccaacgaaaagtacaactccatcaagcgcatcgagggggtcaacgagcagtccgagttcaagttcaccctctacaagaacgatctgatcctgatcaaggacagcgagaacaacgagcagaagttattccgcttcaactcccggaacgacaccgccaagcactacgtggagctcaagccctacgacaaggcccgcttcgacggccagcaggagctgatcacgatcctcgggaacgtggccaagggcgggcagtgcctgaagggcctgaacaagagcaacatctccatcttcaaggtcaagaccgacgtgctcggcaagaagcacatcatcaagaaggagggggatgagcccaagctgaagttctga

SEQ ID NO: 7422 - RNA, 3366 nt, synthetic construct
  misc_feature 1..3366: note = Cas9 variant
  source 1..3366: mol_type = other RNA
atgagcgacctggtgctcggcctggacatcgggatcggctccgtcggggtgggaatcttaaacaaggtgaccggggagatcatccacaagaacagccgcatcttccccgccgcccaggcggagaacaacctcgtccggcgcaccaatcggcagggccgccggctgacgcgccggaagaagcaccgcattgtgcggctgaaccgcctcttcgaggagtccggcctgatcaccgactttaccaagatcagcatcaacctgaacccgtaccagctccgggtgaaggggctgaccgacgagctgtccaacgaggagctgttcatagccctgaagaacatggtcaagcaccgcggcatcagctacctggacgacgcctccgacgacgggaacagctccgtaggcgactacgcccagatcgtgaaggagaacagcaagcagctcgagacgaagacccccgggcagatccagctggagcggtaccagacctacggccaactgcgcggcgacttcaccgtcgagaaggacgggaagaagcaccggctcatcaacgtgttccccacgtccgcctaccgcagcgaggcgctgcggatcctgaagacccagcaggagttcaacccccagatcacagacgagttcatcaaccgctacctcgagatcctgacgggcaagcggaagtattaccacgggccgggcaatgagaagtcccgcacggactacggccggtaccgcaccaacggggagaccctggacaacatcttcggcatcctcatcgggaagtgcaccttctaccccgaggagttcagagccgcgaaggccagctacacggcgcaggagttcaacctgctcaacgacctcaacaacctgactgtgcccaccgagaccaagaagctgtccaaggagcaaaagaaccagatcatcaactacgtcaagaacgagaaggccatgggccccgccaagctgttcaagtacatcgccaagctcctcagctgcgacgttgccgacatcaagggctacagaatcgacaagtctgggaaggcggagatccacacgttcgaggcctaccgaaagatgaagaccctcgagaccctggacatcgagcagatggaccgggagaccctggacaagctcgcctacgtgctgacgctgaacaccgagcgcgagggcatccaggaggccttagagcacgagttcgccgacgggagcttctcccagaagcaggtcgacgagctggtgcagttccggaaggcgaacagcagcatcttcggcaaagggtggcacaacttctccgtgaagctgatgatggagctcatcccggagctgtacgagacctcggaggagcagatgaccatcctgacgcgcctcggcaagcagaagaccacatccagctccaacaagaccaagtacatcgacgagaagctgctgacggaggagatctacaaccccgtggtggccaaaagcgtgcggcaggccattaagatcgtcaacgccgccatcaaggagtacggggacttcgacaacatcgtgatcgagatggcgcgcgagaccaacgaggacgacgaaaagaaggccatccagaagatccagaaggccaacaaggacgagaaggacgccgctatgctcaaggcggccaaccagtacaacggcaaggccgagttaccccactccgtgttccacggccacaagcagctggccaccaagatccggctgtggcaccagcagggggagcgctgcctctacaccggcaagacgatcagcatccacgacctgatcaacaaccccaaccagttcgaggtcgaccacatcctgccgctctccatcaccttcgacgacagcctggcgaacaaggtgctggtctacgccaccgccaaccaggagaagggtcagcggaccccttaccaggcgctcgactccatggacgacgcctggagcttcagggagctgaaggcgttcgtccgggagtccaagaccctgagcaacaagaagaaggagtatctcctgacggaggaggatatctccaagttcgacgtgcagaagaagttcatcgagcgcaacctggtcgacacccggtacgccagccgcgtggtgctcaacgccctgcaggagcacttccgggcccacaagatcgacaccaaggtgtcggtggtgagaggccagttcacctcccagctgcggcgccactgggggatcgagaagactcgcgacacctaccaccaccacgccgtcgacgcgctcatcatcgccgcctccagccagctgaacctgtggaagaagcagaagaacaccctcgtgagctactccgaggaccagctgctggacattgagaccggcgagctcatcagcgacgacgagtacaaggaatccgtgttcaaggccccctaccagcacttcgtcgacacactcaagagcaaggagttcgaggactccatcctgttcagctaccaggtggactccaagttcaaccggaagatcagcgacgctaccatctacgcgacccgccaggccaaggtgggcaaggacaagaaggacgagacctacgtcctcgggaagatcaaggacatctacacacaggacggctacgacgccttcatgaagatctacaagaaggacaagtccaagttcctgatgtaccggcacgacccccagaccttcgagaaggtaatcgagccgatcctggagaactaccccaacaaggagatgaacgaaaaggggaaggaggtgccctgcaaccccttcctcaagtataaggaggagcacggctacatccgcaagtacagcaagaagggcaacgggccggagatcaagtccctgaagtattacgacagcaagctgggcaaccacatcgacatcacccccaagaactccaacaacaaggtcgtgctccagagcgtttccccttggcgggccgacgtctacttcaacaagaccacggggaaatacgagatcctgggactgaagtacgcggacctccagttcgagaaggggaccggcacctacaaaatctctcaggagaagtacaacgacatcaagaagaaggagggcgtggactccgacagcgagttcaagttcaccttgtacaagaatgacctactcctggtgaaggacacggagaccaaagagcagcagctgttccgcttcctcagccggaccatgcccaagaagaagcactacgtcgagctgaagccgtacgacaagcagaagttcgagggcggggaggctctgatcaaggtgctcgggaatgtggccaactccggccagtgcatcaaggggctggccaagagcaacatctccatctacaaggtccgcaccgacgtgctgggcaaccagcacatcatcaagaacgagggcgacaagcccaagctcgacttctga

SEQ ID NO: 7423 - RNA, 3366 nt, synthetic construct
  misc_feature 1..3366: note = Cas9 variant
  source 1..3366: mol_type = other RNA
atgagcgatcttgtgctcggcctggacatagggatcggctccgtcggggtgggcatcctcaacaaggtgaccggagagatcatccacaagaacagccgcatcttccccgccgcccaggcggagaacaacctcgtccggcgcaccaaccggcagggccgccgactgacacgccggaagaagcaccgccgtgtgcgcctgaaccgcctcttcgaggaatccggcctcatcaccgacttcaccaagatctcaatcaacctgaacccgtaccagctccgggtgaaggggctgaccgacgagctgtccaacgaggaactgttcatcgccctgaagaacatggtcaagcaccggggcatcagctacctggacgacgcctcggacgacgggaacagctccatcggcgactacgcccagatcgtgaaggaaaacagcaagcagctcgagacgaagacccccgggcagatccagctggagcggtaccagacctacggccagttgcggggcgacttcaccgtggagaaggacgggaagaagcaccgcctcatcaacgtcttccccacgtccgcttaccggtcggaggcgctgcgcatcctgcagacccagcaggagttcaacccccagatcacggacgagttcatcaacagatacctcgagatcctgaccggcaagcgaaagtactaccacgggccgggcaacgagaagtcccggacggactacggccgataccgcaccagcggggagaccctggacaacatcttcggcatactcatcgggaagtgcaccttctaccccgacgagttccgggccgccaaggcatcctacacggcgcaggagttcaacctgctgaacgacctcaacaacctgaccgtgcccaccgagaccaagaagctgagcaaggagcagaagaaccagatcatcaactacgtgaagaacgagaaggccatgggccccgccaagctgttcaagtacatcgccaagctcctgtcctgcgacgtcgccgacatcaaggggtacagaatcgacaaatcaggcaaggcggagatccacacgttcgaggcctaccggaagatgaagactctcgagaccctggatatcgagcagatggaccgcgagaccctggataagctcgcctacgtgctgacgcttaacactgagcgggagggcatacaggaggccctcgagcacgagttcgccgacgggtccttctctcagaagcaggtcgacgagctggtgcagttcaggaaggcgaacagctccatcttcggcaaggggtggcacaacttcagcgtgaagctgatgatggagctcatcccggagctgtacgagacctccgaggagcagatgaccatcttgacgcggctcggcaagcagaaaaccaccagctccagcaacaagaccaagtacatcgacgagaagctgctgactgaggagatctacaaccctgttgtcgccaagtccgtgcgccaggccatcaagatcgtgaacgctgccatcaaggagtacggggactttgacaacatcgtcatcgagatggcgcgggagaccaacgaggacgatgagaagaaggccatacagaagatccagaaggccaacaaggacgagaaggacgccgcaatgctcaaagcggccaaccagtacaacggcaaggccgagctgccccacagcgtgttccacggccacaagcagctggccaccaagatccgcctgtggcaccagcagggggagcggtgcctctacaccggcaagacgatctccatccacgacctgatcaacaactcgaaccagtttgaggtggaccatatccttcccctctccattacgttcgacgactccctagcgaacaaggtcctagtgtacgccaccgccaaccaggagaaggggcagcgcaccccgtaccaggccctcgactccatggacgacgcctggagcttccgggagctgaaggctttcgtacgcgagtccaagaccctgagcaacaaaaagaaggagtacctcctgacggaggaggacatctccaagttcgacgtgcggaagaaattcattgagcgcaacctggtggacacccggtatgccagccgcgtcgtgttaaacgccctgcaggagcacttccgggcacacaaaatcgacaccaaggtgtccgtcgtgcgcggccagtttacctctcagctgcgccggcactgggggatcgagaagacgcgcgacacctaccaccaccacgccgtggacgcgctcatcatcgccgccagctcccagttaaacttatggaagaagcagaagaacacattggtcagctactccgaggaccagctgctggacatcgagaccggcgagctcatcagcgacgacgagtacaaggagtccgtgttcaaggcaccctaccagcacttcgtcgacacactcaagagcaaagagttcgaagattccatacttttcagctaccaggtcgactccaagttcaaccggaagatcagcgacgccaccatctacgcgaccaggcaagccaaagtgggcaaggataaggccgacgagacctacgtcctcgggaagatcaaggacatctacacgcaggacggctacgacgccttcatgaagatatacaagaaggacaagtccaagttcctgatgtaccggcacgatccacagaccttcgagaaggtgatcgagcccatcctggagaactacccgaataagcagatcaacgagaaggggaaggaggtcccctgcaaccccttcctgaagtacaaagaggagcacggctatatccgcaagtacagcaagaagggcaacgggcccgagatcaaaagcctgaagtactacgacagcaagctgggcaaccacatcgacattaccccgaaggactccaacaacaaggtggtcctccaaagcgtgtccccgtggcgggcggatgtttatttcaacaagaccacggggaagtacgagatcctgggcctgaagtacgccgacctccaattcgagaaggggaccggcacctacaagatcagccaggagaagtacaacgacatcaagaagaaggagggcgtcgacagcgactccgagttcaagttcacactgtacaagaacgacctgctcctggttaaggacactgagaccaaggagcagcagctgttccgcttcctcagccggaccatgccaaagcagaagcactacgtggagcttaaaccctacgacaagcagaagtttgagggcggggaagccctgatcaaggtcctggggaacgtggccaactccggccaatgcaagaaggggctgggcaagagcaacatctccatctacaaggtgagaaccgacgtcctgggcaaccagcatatcatcaagaacgagggggacaagccgaaattagacttttga

SEQ ID NO: 7424 - RNA, 3366 nt, synthetic construct
  misc_feature 1..3366: note = Cas9 variant
  source 1..3366: mol_type = other RNA
atgagcgacctggtgctcggcctcgacatcgggatcggctccgtcggggtgggcatcctgaacaaggtgaccggggagatcatccacaagaacagtcgcatcttccccgccgcccaggcggagaacaacctcgtccggcggaccaaccggcagggccgccggctgacgcgccggaagaagcacagacgggtgcgcctgaaccgcctcttcgaggagtccgggttgatcaccgacttcaccaagatcagcatcaacctgaacccgtaccagctccgggtcaaggggctgaccgacgagctctccaacgaggagctgttcatcgccctgaagaacatggtcaagcaccggggcatcagctacctggacgacgcctccgacgacgggaacagctccgtgggcgactacgcccagatcgtgaaggagaacagcaagcagctcgaaacgaagacccccgggcaaatccaactggagcgctaccagacctacggccagctgcggggcgacttcaccgtcgagaaggacgggaagaagcaccgcctcatcaacgtgttccccacgtccgcttaccggagcgaggcgctgaggatcctgcagacccagcaggagttcaacccgcagatcacagacgagttcgtgaaccggtacctcgagatcctgaccggcaagcgcaagtactaccacgggccgggcaacgagaagtcccggacggactacggccgctaccgcaccaacggggagaccctggacaacatcttcggcatcctcatcgggaagtgcaccttctaccccgaggagttccgggccgccaaggccagctacacagcgcaggagttcaacctgctgaacgacctcaacaacctgacggtccccaccgagaccaagaagctgtccaaggagcagaagaaccagatcatcaactacgtgaagaacgaaaaagccatgggccccgccaagctgttcaagtacatcgccaagctcctgagctgcgacgtggccgacatcaaggggtaccgcatcgacaagtccggcaaggcggagatccacactttcgaggcctaccggaagatgaagaccttagagaccctggacatcgagcagatggaccgcgagaccctggacaagctcgcctacgtcttgacgctgaacaccgagcgcgagggcatccaggaggccctcgagcatgagttcgccgacgggagcttctcccagaagcaggtcgacgagttggtgcagttccgcaaggcgaacagctctatcttcggcaaggggtggcacaacttctccgtgaagctgatgatggagctcatcccggagctgtacgagacaagcgaggagcagatgaccatcctgaagaggctcggcaagcagaagacgacctccagctccaacaagaccaaatacatcgacgagaagttactgaccgaggagatctataaccccgtggtggccaagagcatccgacaggccatcaagatcgtcaacgccgccatcaaggagtacggtgacttcgacaacatcgtgatcgagatggcgcgggagacgaacgaggacgacgagaagaaggccatccagaagatccagaaggccaacaaggacgagaaggacgccgccatgctcaaggcggccaatcagtacaatggcaaggccgagctgccccactccgtgttccacggccacaagcagctggccaccaagatccgcctgtggcaccaacagggggagcggtgcctctacaccggcaagaccatcagcatccacgacctgatcaacaaccccaaccagttcgaggtcgaccacatcctgccgctctccatcacgttcgacgacagcctggcgaacaaggtgctggtctacgccaccgccaaccaggagaaagggcagcgcaccccctaccaggccctcgactccatggacgacgcctggagcttccgggagctgaaggcattcgtgcgcgaatccaagaccctgagcaacaagaagaaggagtacctactgaccgaggaggacatctccaagttcgacgtgcggaagaagttcatcgagcgcaacctggtcgacacgcggtacgccagccgcgtggtgctcaacgccctgcaggagcacttccgagcccacaagatcgacaccaaggtctccgtggtgcgcggccagttcaccagccagctgcgccggcactgggggatcgagaagacccgcgacacgtaccaccatcacgccgtcgacgcgctcatcatcgccgcctccagccagctgaacctgtggaagaagcaaaagaacaccctcgtgagctactccgaggaccagctgctggacatcgagaccggcgagctcatcagcgacgacgagtacaaggagtccgtgttcaaggctccctaccagcacttcgtcgacaccctcaagagcaaggagttcgaggactccatcctgttcagctaccaggtggactccaagttcaaccggaagatcagcgacgccacgatctacgcgacccgccaggccaaggtgggtaaggacaagaaggacgagacctacgtcctcgggaagatcaaggacatctacacccaggacggctacgacgccttcatgaagatctacaagaaggacaagtccaagttcctgatgtaccgtcacgacccccagacgttcgagaaggtgatcgaaccgatcctggagaactaccccaacaaggagatgaacgagaaggggaaggaggtgccctgcaaccccttcctcaagtacaaggaggagcacggctacatccgcaagtacagcaagaagggcaacgacccggagatcaaatccctcaagtactacgacagcaagctggggaaccacatcgacatcacccccaaggactccaacaacaaggtcgtgctccagagcgtgtccccctggcgggccgacgtctacttcaacaagaccaccggcaagtacgagatcctggggctgaagtacgctgacctccagttcgagaagggcacggggacctacaagatcagccaggagaagtacaacgatatcaagaagaaagagggcgtggactccgacagcgagttcaagttcaccctttacaagaacgacctgctcctggtgaaagacacagagacgaaggagcagcagctgttccgcttcctcagccggaccatgcccaagcagaagcactacgtcgagctgaagccgtacgacaaacagaagttcgagggcggggaggccctgatcaaggtcctcggcaacgtggccaactccgggcagtgcaagaagggcctgggaaagagcaacatatccatctacaaggtccgcaccgacgtactggggaaccagcacatcatcaagaatgagggcgacaagcccaagctcgatttctga

SEQ ID NO: 7425 - RNA, 3366 nt, synthetic construct
  misc_feature 1..3366: note = Cas9 variant
  source 1..3366: mol_type = other RNA
atgaacggcctggtgctcgggctggacatcggcatcgcctctgtcggggtgggcatcctggagaagaactccgggaagatcatccacgccaacagccgcctcttccccgcggccaccgccgacaacaacgtggagcggcgcaagaaccggcaggcccgccggctgcaccgcaggaagaagcaccggggcgtccggttccaggacctgttcgaagactacggcctcctgaccgacttctccaaggtgagcatcaacctgaacccgtaccgcctccgggtggacgggctgaaccagcagctgacgaacgaggagctgttcatcgccctcaagaacatcgtcaagcgcagaggcatctcctacctcgacgacgcgagcgaggacgggggcaccgtgtccagcgactacgggaaggccgtggaggagaaccgcaagctcctggctgagcagacccccgggcagattcagctggagcggttcgagaagtacggccaggtccgcggggacttcaccgtggtggagaatggcgagaagcggcgcctcatcaacgtcttctccacgagcgcttaccggaaggaggcggagcgcatcctgcggaagcagcaagagttcaactccaagatcaccgacgagttcatcgaggactgcctgaagatcctaaccgggaagcgcaagtactaccacggccccggcaacgagaagtcccgtaccgactacgggcggttccgcacggacggcaccaccctggacaacatcttcgggatcctgataggcaaatgcaccttctaccccgacgagtacagagccagcaaggccagctacaccgcccaggagttcaatctcctgaacgacctgaacaacctcaccgtcccgaccgagaccaagaagctgtccgaggagcagaagaaggtgatcgtcgagtacgccaaggaggcgaagacgctgggggccagcaccctcctgaagtacatcgccaagatgatcgacgcctccgtggaccagatccgcggctacagagtggacgtcaacaacaagcccgagatccacaccttcgaggcctaccgcaagatgcagagcctggagaccatctccgtgggcgagctcagccggaacgtgctggacgagctggcgcacatcctcacgctgaacaccgagcgcgaggggatcgaggaggccatcaacaccaagttaaaggacagcttctcccaggaccaggtcctcgaactggtgcagttccggaagaacaacagctccctgttcagcaagggctggcacaacttctccctcaagctgatgatggagctgatccccgagctctacgagaccagcgaggagcagatgacgatcttgacccgcctggggaagcagaagtccaaggagatcagcaagcggaccaagtacatcgacgagaaggagctcaccgaggagatctacaaccccgtggtcgccaagtccgtgagacaggccatcaaaatcatcaacgaggccacgaagaagcacggcatcttcgacaatatcgtcatcgaaatggcgcgggagaacaacgaggaggacgctaagaaggactacatcaagcgccagaaagccaaccaggacgagaagaacgctgccatggagaaggcggccttccagtacaacgggaagaaggagcttccggacagcatcttccacggccagaaggagctggccacgaagatccggctatggcaccagcagggcgagaagtgcctctacaccgggaagaacattcccatctccgatctgatccacaaccagtacaagtacgaaatcgaccacatcctgcccctcagcctgtccttcgacgacagcctgtccaacaaggtgctcgtgctggccaccgcgaaccaggagaaaggccagcgcacgcccttccaagccctggacagcatggacgacgcctggtcctaccgggagttcaagagctacgtcaaggagtccaagctcctggggaacaaaaagaaggagtaccttctcaccgaggaggacatcagcaagatcgaagtgaagcagaagttcattgagcgcaacctgatagacacccggtacagctcccgcgtggtcctgaacgccctccaggacttctataaggcccacaagttcgacacaacgatcagcgtggtgcgcggccagttcacctcccagctgcggcgcaagtgggggctggagaagtcccgggagacctatcaccaccacgcggtcgacgccctcatcatcgcagccagcagccagctgcgcctgtggaagaagcagaacaacccgctcatcgcctacaaggaggggcagttcgtggactccgagaccggcgagatcatcagcctgtccgacgacgagtacaaggagttagtgtttaaggctccctacgaccacttcgtggacaccctctcttccaagacgttcgaggacagcatcctgttctcctaccaggtggacagcaagttcaaccggaagatctccgacgccaccatctacgccacccgcaaggccaagctggacaaggagaagtccgaggagacctacgtgttagggaagatcaaggacatctacagccaggccgggtacgacgcgttcatcaagatctacaacaaggacaagagcaagttcctgatgtaccacaaggacccccagacgttcgagaaggtcatagaggagatcctgcggacctaccccagcaaggagctcaacgacaagaacaaggagatcccgtgcaaccccttcgaaaagtaccgccaggagaacgggcccatccggaagtactccaagaagtcgaacggccccgagatcaagagcctgaagtactacgacaacaagctgggcaaccacatcgacatcaccccggagagctccgacaaccaggtggtgttgcagagcctgaagccctggcgcaccgacgtctacttcaaccaccagacgaagaagtacgagctgatgggactcaagtactccgacctgagcttcgaaaagggctccgggaagtacagtatctccaaccagaagtacaacagcatcaagcggatcgagggcatcgacgagcagtccgagttcaagttcaccctgtacaagaacgacctcatcctgatcaaggacagcgagaacaacgagcagaagctgttccgcttcaactcgcggaacgacaccgccaagcactacatagagctcaagccctacgacaaggccaagttcgacggggagcaggagctgatcaccatcctaggcaatgtggccaagggcgggcgctgcctaaagggcctgaacaagagcaacatctccatcttcaaggtgaagacggacgtcctggggaagaagcacatcatcaagaaggagggcgacgagcccaagctcaagttctga

SEQ ID NO: 7426 - RNA, 3366 nt, synthetic construct
  misc_feature 1..3366: note = Cas9 variant
  source 1..3366: mol_type = other RNA
atgaacggcctggttcttgggctggacatcggtatcgccagcgtcggggttggcatcctgaacaaggacaccggggagatcatccacaccaactctcgcatcttccccgccgcgacggccgacaacaacgtggagcggcgcaacagccggcaggaccgccggctcaaccgccggaagaagcaccgcggcgtccggctgcacgacctgttcgaggactacgacctcctgaccgacttctccaaggtgagcatcaacctgaacccgtaccgcctccgggtgcagggcctggacaactccctgaccaccgaggagctgttcatagccctcaagaacatcgtcaagcgccgggggatcagctacctggacgacgcctccgaggacggcggggtggtgagctctgactacgggaaggccgtcgaggagaaccgcaagctcctggcagagcagacgcccgggcagatccagctggagcggttcaagaagtacggccaggtgcgcggcgatttcaccgtggtcgagaacggggagaagcggcgcctcatcaacgtgttcagcacctccgcctaccggaaggaggccgagcgcatcctgcgtaagcagcaggagttcaacaaccagatcaccgacaaattcatcgaggactacctgaagatcctcacggagaagcgcaagtactaccacggccccgggaacgagaagtcccgcaccgactacggccggttccgcaccgacggcaccacgctggacaacatctttgggatcctcatcggcaagtgcaccttctaccccaacgagtaccgggcgagcaaggcgagctacaccgcgcaggagttcaacctcctgaacgacctgaacaacctcaccgtgccgacggaaaccaagaagctgtccgaggagcagaagaagaccatcgtcgagtacgccaagtcggccaagaccctgggggcctccactctcctgaagtacatcgcgaagatgatcgacgcctcggtggaccagatccgaggctaccgggtcgacgtcaacaataagcccgagatgcacaccttcgaggtgtaccgcaagatgcagtccctggagaccatcagcgtgtgggaacttagccggaacatcctggacgagctggcccacatcctcaccctgaacacggagcgcgaggggatcgaggaggccatcaacaccaagttaatggacgtcttctcccaggaccaggtgctcgagctggttcagttccggaaaaacaacagctccctgttcagcaaggggtggcacaacttctcccgcaagctcatgatggagctgattcccgagctgtacgagaccagcgaggagcagatgaccatcctcacgcggttgggcaagcagaagtccaaggagaccagcaagcgcaccaaatacatcgacgagaaggaggtcaccgaggagatctacaaccccgtggtcgccaagtccgtgcggcaggcgatcaagatcatcaacgaggccacgaagaagtacgggatcttcgacaacatcgtgatcgagatggcacgcgagaacaacgaggaggacgctaagaaggactatatcaagcggcagaaggccaaccaggacgagaagaacgtcgcgatcgagaaggccgccttccagtacaacggcaagaaggagctgccggacagcatcttccacggacacaaggagctcgccaccaagatccgcctgtggcaccagcagggcgagaagtgcctgtacaccgggaagaacatccccatctccgacctgatccacaaccagtacaagtacgagatcgaccacatcctccccctgagcctgtccttcgacgactcgctctccaacaaggtgctggtgctggccaccgcgaaccaggagaagggccagcggacgcccttccaggccctcgacagcatggacgacgcctggtcctaccgcgagttcaagagctacgtcaaggactccaagctactgggcaacaagaagaaggactacctcctgacagaggaggacatcagcaagatcgaggtgaagcaaaagttcatcgagcggaacctggtggacacccgctacagctcccgcgtcgtgctcaacaccctgcaggacttctacaaggcccacaagttcgacaccacgatcagcgtggtccgggggcagttcacttcccagctgcgccggaagtggggcctcgagaagtcccgcgagacctaccaccaccatgcggtggacgccctgatcatcgccgccagcagccagctgcggctctggaagaagcaggccaacccgctgatctcctacaaggaggaccagttcgtggacagcgaaaccggggagataatctccctgacggacgacaagtacaaggagctcgtgttcaaggcgccctacgcccacttcgtggataccctgtcctccaagaagttcgaggacagcatcctgttctcctaccaggtggacagcaagtacaaccgcaagatctccgacgccaccatctacgccacccggaaggtcaagctcgacaaggacaagagcgaggagacgtacgtgctgggcaagatcaaagacatctactcccaggccggatacgacgcattcatcaagatctacaacaaggacaagagcaaatttctgatgtaccacaaggatccccagaccttcgagaaggtgatcgaggagatcctccgcatctaccccagcaaggagttcaacgagaaaaacaaggaggtcccgtgcaaccccttcgagaagtaccggcaggagaacggccccatctgcaagtactccaaaaagggcaacggtcccgagatcaagagcctgaagtattacgacaagaacatcccggagtccttcatcgacatcacccccagcaactccaagaacaaggtgatcctgcgccagctcaacccctggcggaccgacgtgtacttcaaccaccagaccgagaagtacgagctgctgggcctcaagtacgccgacctgcagttcgagaaaaagaccgagacctacagcatcaccatcgacaagtacaacgagatcaaggagaaggagggggtcggcgagcactccgagttcaagttcacgctgtacaagaacgacttgctcctgatcaaggacatggagatcaaggaggagcagatcttccgcttcctcagccggaccatgcccaacaagaagcactacgttgagctgaagccgtactacaagggcaacttcgaggggaaggagcgcataaaggtgttcaacaccacctccaacggccggtgcctgaaggggctcggcaagaaggggctgtccatctacaagattaagacggacgtcttaggcaacaagcacttcatcaagaaggagggcgagaagcccaagctcaagttctga

SEQ ID NO: 7427 - RNA, 3366 nt, synthetic construct
  misc_feature 1..3366: note = Cas9 variant
  source 1..3366: mol_type = other RNA
atggacaggaccgaggtgaacatcggtttcgacatcgggatcagctccgtcggctggagcgtggtggccaccaagtccgggcggatcctggagagcggcgtctccctattcagcggggcctccgcggccaagaatgaggagcgccggaacttccgccagagccggcgcctgctgcggcgccgaaagaaccgcatctccgaccttaagaagtacctgaaggagcagagcttcacgtacaacggcgagctgctcaacgagaacccctacgagattagggtgaagggcctgacagagaagctgtccaaggaggagatcgccctcgccctgttgcacatcgtgaagcgccgcggggtcagctacgacctcggcgacatcgaggaggaggggaccacgggctcctacaaggagggggtgaagaaaaaccagaaactgctgaaggagaagacgccggccgagatccagttccagcggctcaagaagttccacaaggtgagaggccagatcgcgatcgacgagaacgacgtgcttctgaacgtgttccccaaccacgcctacgtggacgaggcccagcagatcctctacacccagcaggagttctaccccgagatcaacgagaccttcatcaaccaggtcaccgacttcatcagccgcaagcgggactacttcatcggccccgggtccgagaagtcccgcacggactacggcatctaccggaccgacgggaccaccctgcagaacctgttcagcatcctcatcggcaaggacaagatcttcccggacgagttcagggccgcgggcaacagctacacggcccaggtgtacaacttactgaacgacctgaacaacctggccatcgatgacacagagaccgggaagctgaccaagcagcagaaggagaagatcatcatggagctcaagacgaccgagaagtccgtgaatatgatgaagctgatcgccaagaccgccggcgtcaccgtggagcagatcagccggtaccgcatcaaccgcgacggcaagagcgagatccacaacatggcggtgtaccggaagatccgcaaggtcttcctggagctcgggtacgagatcaacgagtggccctcccagctgctggacgagctcggggacgcccttagcctgaacacggagaacggcgagatccggcgcatcctcaccgacaacctggccaacaagtacaagatcctggaccagcagctcatcaacctgatcatcgagaacaagaacgccttcaccctgtccaccaaccagaagtggcaccggttcagctacaagacgatgaagatcctcatccccgagctgctggaaaccaacaaggagcagatgaccatcctcaccgagatgggcctgatgaagaaggaccagcgcaactacgtggggaagaacaagatcgactcagaggccctgctcgagaacctgtacaaccccgtggtccgcaagagcacgcggcagaccatgaaactgttcaacaccctgctcaagaagtacccgaacatcgcgtacgtggtgatcgagatgccccgggaggacgacgaggacaaggcccgccgggactacgtcaagttccagaaggacaacgagaaggagaaggacgccgccctgaagaacttcatcatggagtccggcaagagcgaggccgaggtgatcgcgaagtaccgccagtccaagaagttccgcagcaaggtgcgcctgtggtaccagcagatggggcggtgcctctactccggcaaggccatgcccgccgagcgcgtcttccgggacgaccacttcaccgacatcgaccacgtgatccccctgagcgtctccttcgacgacgggatgaacaacaaggtgctgtgcctcgccgagatgaaccgccagaaggacaagcaaacgccgtacgcctttttcaacgcgggccacggccaggggttccaggccatgaacgccatgctgaagaacaacaaccggatcagctccgctaagaagcgcaacctcctgttcaccgagaacctgaacgacctggaagtgcgcaagcggttcatcgagcgcaacctcgtcgacacccggtacgcgagccgcgtggtgctgaacgagctgcagcagttcgtcaaggccaagcagctcgacaccaaggtgacggtgatccggggcaagttcacctccaagctgcgcgagaagtggaacatcaacaagagccgggacacccaccaccaccacgccgtcgacgccgccgtgatcgcggtgtccccgatgcttaacctctgggagaagggggccagcatcatccccaacaaggtcggcgagaacgtgattgacatcaagaccggggaaatcataaccgaccacgactacgaggccgacgtctacgagctgccctacgccaagttcctcgagcagatcccgaaggtcaagaaggacatcaaattccgccaccaggtggacaagaagaagaaccggaaggtgagcgacgccacgatctacaccacgcgcaaggctaaggtcggcaaggacaaggaggagaccgactacgtgctcggcacgatcaaggacatctactccctggagggatacgtgagcttcaagaagatctacaacaaggacaaggccaagttcctgatggcccggatcgaccccaagacgttcgagaagctcgagaagatcgtcgccgagtaccccgagtcgattgaggtggtgcaggacaacggcaaggtcgacgtgcagaagatcagccccttcgagctttaccgcaaggacaacgggttcgtgaccaagttcgccaagaagaacaacggcccggcggtcaaatccctgaagtactacgacagcaagctcggctccagcatcgacgtgacccccgacaatgccaagaacaagaaggtcatcctgcagtccctgaagccctggcggactgacgtctacttcaacgaggaaaaccaggagtacgagatcatggggctcaagtacagcgacctgaagttcggcaagaacgggaagtacggcgtgccgaaggtgcgctacgaggagatcaagcaggaggaggagatctccgaggggagcaagttcctgttctccctctaccggggcgaccgcatcaaggtcaccaacgagctgggcgagaacctggacctcctgttcagctcccggaccctgccggcccagaaggggtacgtggaactcaagcccatcgacaagactaagtttgacggcaaggagaaagtgagcttctacgggacggttacccccaacggccagttcgtgaagaagttcgccaagaaggggtacaagatcttgaagctgaacaccgacgagctcggcaacacttacatcgagaacggcgaaaaggagccctccgacatactggacatgtga

SEQ ID NO: 7428 - RNA, 3366 nt, synthetic construct
  misc_feature 1..3366: note = Cas9 variant
  source 1..3366: mol_type = other RNA
atgaacggcctggtgctcgggctggacatcggcatcggcagcgtcggcgtggggatcctgaacaaggacaccggagagatcatccacgccaactcccgcatcttccccgccgcgaccgccgacaacaacgtggtccggcgcagctcccggcagggccgccggctcaaccaccgcaagaagcaccggagcgtgcgcctgaaggacctgttcgagtactacgacctcctgacggacttctccaaggtgagcatcaacctgaacccgtaccggctccgcgttaacgggctgaaccagcagctgaccaacgaggagctgttcatcgccctcaagaacatcgtgaagcggcgcggcatctcctacctggacgacgccagcgaggacgggggcgctgtgtccagcgactacgggaaggcggtcgaggagaaccggaagctcctggcagagcagacccccggccagatccagctggagcgcttcgagaagtacggccaggtgcgcggggacttcaccgtggtcgagaacggggagaagcggcggctcatcaacgtgttctccacgagcgcctacaagaaggaggccgagcgcatcctgcggaagcagcaggagtacaacaaccagatcatggacgagtttatcgcggactacctgaccatcctcaccgggaagcgcaagtactaccacggccccggcaacgagaagtcccggaccgactacgggcgcttccgaacggatggcaccaccctggacaacatcttcgggatcctgatcggcaagtgcaccttctaccccgagaagtaccgggccagcaaggcctcctatacggcccaggagttcaacctcctgaacgacctgaacaacctcaccgtgccgacagagaccaagaagctgagcgaggagcagaagaagactatcgtcgagtacgccaagtccgcgaagaccctgggggccagcaccctcctgaagtacatcgccaagatgatcgacgcctccgtggaccagatacgcggctaccgggtggacgtcaagaacaagcccgagatgcacaccttcgaggtgtaccgcaagatgcagagcctggagacgatcagcgtgggcgagttctcccgggaggtcctcgacgagttagcccacgtgctgaccctcaacaccgagcgcgaggggatcgaggaggcgatcaacaccaaactacgggacagcttctcccaggaccagatcctggagctcgtgcagttccgcaagaacaacagctccctgtttagcaagggctggcacaacttctccctgaaactcatgatggagctgatccccgagctgtacgagacgagcgaggagcagatggccatcctcacccggctggggaagcagaagttcaaggagacatccaagcgcaccaagtacatcgacgagcaggaggtcacggaggagatctacaaccccgtggtcgccaagagcgtgcggcaagccatcaagataatcaacgaagccaccaagaagtacggcatcttcgacaacatcgtgatcgagatggcgcgcgagaacaacgaggaggaggccaagaaggactacatcaagcggcagaaggccaaccacgacgagaagaacgccgccatggagaaggcggccttccagtacaacggggagaaggagctgccggactccattttccacggccacaaggagctcgccaccaaggtccgcctgtggcaccagcagggcgagaagtgcctgtacaccgggaagaacatccccatcagcgacctgatccacaaccagtacaagtacgagatcgaccacattctccccctgtctctgagcttcgacgactccctaagcaacaaggtgctggtgctggccacggcgaaccaggagaagggccagcggacccccttccaggccctcgactccatggacgacgcctggagctaccgcgagttcaagtcctacgtcaaggacagcaaaagcctcgggaacaagaagaaggactacctgctcaccgaggaggacatctccaagatcgaggtgaagcaaaagttcatagagcggaacctggtggacacccgctacagctcccgggtggtgctgaacacgctccaggacttctacaaggcccacaagtttgacacaaccatcagcgtggtccgcggccagttcacctcccagctgcgccggaagtgggggctggagaagtcccgcgagacctaccaccaccacgccgtggacgcgctcatcatcgccgccagcagccagctgcggctgtggaagaagcagaacaacccgctcatctcctacaaggaggggcagttcgtggacagcgagacgggcgagatcatctccctgaccgacgacgagtacaaggagctggtcttcaaggccccctacgaccacttcgtcgacaccctccgcagcaagaagttcgaggactccatcctattcagctaccaggtggactccaagtttaaccggaagatcagcgacgccaccatctacgcgacgcgcaagaccaagctggacaaggacaagtccgaggagacctacgtactcgggaagatcaaggacatctacagccagagcggctacgacgctttcatcaagatctacaacaaggacaagtccaagttcctgatgtaccacaaggatccccagaccttcgagaaggtgatcgaagagatcctgcggacgtaccccagcaaggagttcaacgaaaagaacaaggaggtgtcctgcaacccgttcgagaagtacaagcaggaaaacgggcccatccgcaagtacagcaaaaagggcaacggccccgagatcaagtccctcaagtactacgacaagaacatccccgagagcttcattaacatcaccccgtccaacagcaagaacaaggtcatcctgcggcagctgaacccctggcgcaccgacgtgtacttcaaccaccagaccgagaagtacgagctcctggggctgaagtacgccgatctccagttcgagaagaagacgggcacctactccatcaccatcgacaagtacaacgagatcaaggagaaggagggggtgagcgagcactccgagttcaagttcaccctgtacaagaatgacctgctcctgatcaaggatacggagatcaaagaggagcagatcttccggttcctgagccgcaccatgcccaaccagaagcactacgtcgagctcaagccctactacaagggcaactttgaggggaaggagcggatcaaggtgttcaacactacctctaacggccgctgcctgaagggcctgcggaagaaggggctcagcatatacaagatcaagacggacgtgctaggcaacaagcacttcatcaagaaagagggggagaagccgaagctgaagttctga

SEQ ID NO: 7429 - RNA, 3366 nt, synthetic construct
  misc_feature 1..3366: note = Cas9 variant
  source 1..3366: mol_type = other RNA
atgagcgacctggtgctcggtctcgacatcgggatcggctccgtcggggtgggcatcctgaacaaggtgaccggggagatcatccacaagaacagccgcatcttccccgccgcccaggcggagaacaacctcgtccggcgcaccaaccggcagggccgccggctgacgcgccggaagaagcacaggatcgtgcggctgaaccgcctcttcgaggagtccggactgatcaccgacttcacgaagatcagcatcaacctgaacccgtaccagctccgggtgaaagggctgaccgatgagctgtccaacgaggagcttttcatcgccctcaagaacatggtcaagcaccgcggcatcagctacctggacgacgcctccgacgacgggaacagttccgtgggcgactacgcccagatcgtgaaggagaacagcaagcagctcgagacgaagacccccgggcaaatacagctggagcggtaccagacctacggccagctccgcggcgactttaccgtcgagaaagacgggaagaagcaccgactcatcaacgtgttccccacgtccgcctaccgcagcgaggcgctgcggatccttcagacccagcaggagttcaacccccagatcaccgacgagttcatcaaccgctacctcgagatcctgaccggcaagcgcaagtactaccacgggccgggcaacgagaagtcccgcacagactacggccgctaccgcaccagcggggagaccctggacaacatcttcggcatcctcatagggaagtgcaccttctaccccgacgagttccgcgccgccaaggcctcctacaccgcgcaggagttcaacctgctgaacgacctcaacaacctgaccgtgcccaccgagaccaagaagctgagcaaggagcagaagaaccagatcatcaactacgtcaagaacgagaaggccatgggccccgccaagctgttcaagtatatcgccaagctcctgtcctgcgacgtggccgacatcaaagagtaccggatcgacaagagcgggaaggcggagatccacacgttcgaggcgtaccgcaaaatgaagaccctcgagaccctggacatcgagcagatggaccgggagaccctggacaagctcgcctacgtgctgacgctgaacacagagcgcgagggcatccaggaggccctcgagcacgagttcgccgacggctccttcagccagaagcaggtcgacgagctggtgcagttccgcaaggcgaacagctccatcttcgggaagggctggcacaatttcagcgtgaagctgatgatggagctcatcccggagctgtacgagacctccgaggagcagatgaccatcttgacgcgcctcgggaagcaaaagaccaccagctcctccaacaagaccaagtacatcgacgagaagctgctgacggaggagatctacaaccccgtcgtggccaaatccgtgcggcaggccatcaagatcgtcaacgccgccatcaaggagtacggcgacttcgacaatatcgtgatcgagatggcgcgcgagaccaacgaggacgacgagaagaaggccatccagaagatccagaaggccaacaaggacgaaaaggacgccgccatgctcaaggcggccaaccagtacaacgggaaggccgagctgccccacagcgtgttccacggccacaagcagctggccacaaagatccggctgtggcaccagcagggcgagcgctgcctctacaccgggaagacgatctccatccacgacctgatcaacaacagcaaccagttcgaggtcgaccacattctgcccctctccatcaccttcgacgacagcctggcgaacaaggtgctggtctacgccaccgccaaccaggagaagggccagcggaccccgtaccaggctctcgactccatggacgacgcctggagcttccgcgaactgaaggcgttcgtgcgggagtccaagaccctgagcaacaagaagaaggagtacctcctaacggaggaggacatctccaagttcgacgtgcgcaagaagttcatcgagcggaacctggtcgacacccgctacgccagccgggtggtgctcaacgccctgcaggagcacttccgcgcccacaagatcgataccaaggtctccgtggtgcgcgggcagttcaccagccagctgcggcgccactggggcatcgagaagacgcgggacacctaccaccaccacgccgtcgacgcgctcatcatcgccgcgagcatccagctgaacctgtggaaaaagcagaagaacaccctcgtgtcctacagcgaggaccagctgctcgacatcgagaccggggagctaatctccgacgacgagtacaaggagagcgtgttcaaagccccctaccagcacttcgtcgacacgctgaagtccaaggagttcgaggacagtatcctgttctcctaccaggtggacagcaagttcaaccgcaagatctccgacgcgaccatctacgcgacccggcaggccaaagtgggcaaggacaaggccgacgagacctacgtcctcggcaagatcaaggacatctacacgcaggacgggtacgacgccttcatgaagatctacaagaaggacaagagcaagttcctgatgtaccgccacgacccccagaccttcgagaaggtgatcgagcccatcctggagaactacccgaacaagcagatcaacgagaagggaaaggaggtacccgtcaaccccttcctcaagtacaaggaggagcacgggtacatccggaagtactccaagaagggcaacggccccgagatcaagagcctgaagtactacgactccaagctggggaaccacatcgacatcactccgaaggacagcaacaacaaggtggtgctccagtccgtcagcccctggcgcgcggacgtgtacttcaacaagaccacgggcaagtacgagatcctggggctgaagtacgccgacctccagtttgagaagggcaccgggacctacaagatctcccaagagaagtacaacgacatcaaaaagaaggagggcgtggacagcgacagcgagttcaagttcaccttgtacaagaacgacctgctcctagtcaaggacacagagaccaaggagcagcagctgttccggttcctctcgcgcacgatgcccaaacagaagcactacgtggagctgaagccctacgacaagcagaagttcgagggcggggaggccctgatcaaagtgctcggcaacgtcgccaacagcgggcaatgcaagaagggcctgggcaagtccaacatcagcatctacaaggtgcggaccgacgtgctgggcaaccagcacatcatcaagaacgaaggcgacaagccgaagctcgacttctga

SEQ ID NO: 7430 - RNA, 3366 nt, synthetic construct
  misc_feature 1..3366: note = Cas9 variant
  source 1..3366: mol_type = other RNA
atgaacggcctggtgttagggctggacatcggcatcgccagcgtcggggtgggcatcctggagaagaactccgggaagatcatccacgccaacagccgcctcttccccgcggccaccgccgacaacaacgtggagcggcgcaagaaccggcaggcccgccggctgaaccgccggaagaaacaccgtggcgtccggttccaggacctgttcgaggactacggcctcctgaccgacttctccaaggtgagcatcaacctgaacccgtaccgcctccgggtagacgggctcaaccagcaactaacgaacgaggagctgttcatcgccctcaagaatatcgtcaagcggcgcggcatctcctatctggacgacgcgagcgaggacgggggcgccgtgtccagcgactacgggaaagccgtggaggagaaccgcaagctcctggccgagcaaacccccggccagatccagctggagcggttcgagaagtacggccaggtccgcggggacttcaccgtggtggagaacggcgagaagtgccggctcatcaacgtcttctccaccagcgcgtaccgcaaggaggccgagaagatcctgaggaagcagcaggagttcaacaaccagatcacggacgagttcatcgaggactacctgaagatcctcaccgggaagcgtaagtactaccacggccccggcaacgagaaatcccggactgactacgggcgcttccgcaccgacggcacgaccctggacaatatcttcggggtcctgatcggcaagtgcaccttctaccccaacgagtaccgggccagcaagtccagctacaccgcccaggagttcaacctcctgaacgacctgaacaacctcacggtgccgaccgagaccaagaagctgtccgaggagcagaagaaggtcatcgtggagtacgccaaggaggcgaagaccttgggggccagcactctcctgaagtacatcgtgaaaatgatcgatgcctccgtcgaccagatctcgggctaccgcgtggacgtgaacaacaagcccgagatgcacacctttgaggtctaccggaagatgcagtccctggagaccatcagcgtgggcgagctcagccgcaacgtgctggacgagctggcccacatcctcaccctgaacacggagcgggagggaatcgaggaggccatcaactccaagctgatgggcgtcttcagccaggaccaggtgctcgagctggtccagttccgcaagaacaactccagcctgttctccaaggggtggcacaacttcagcctcaagctgatgatggagctgatccccgagctctacgagacgtccgaggagcagatgaccatcctgaccagactgggtaagcagaagtccaaggagacgagcaagcgcaccaagtacatagacgagaaagagctcaccgaggagatctacaaccccgtggtggccaagagcgtccggcaggcgatcaagatcatcaacgaggccaccaagaagcatggaatcttcgacaacatcgtgatcgaaatggccagagagaacaacgaggaggacgccaagaaggactacatcaagcggcagaaggcgaaccaggacgagaagaacgccgccatggagaaggcagccttccagtacaacggcaagaaggagctgcccggcaacatcttcaacggccacaaggagctggcgacgaagatccgcctgtggcaccagcagggcgagaagtgcctctacaccggcaagaccatccccatctccgatctgatccacaaccagtacaagtacgagatcgaccacatcctgcccctcagcctgtcctttgacgacagcctgtccaataaggtgttagtccacgccaccgccaaccaggagaagggccagcggacgcccttccaggcactggacagcatggacgacgcgtggtcctaccgcgagttcaagagctacgtgaaggaccttaagtccctcagcaacaagaagaaggactacctgctgaccgaggaggacatcagcaagatcgaggtgaagcagaagttcatcgagcggaacttagttgacacccgctactccagccgggtggtgctgaacgccctgcaggacttctacaagtcccaccagttcgacacaacaatcagcgtcgtgcgcgggcagttcacctcccaactccggcgcaagtggggcctggagaagtcccgcgagacctaccaccaccacgccgtggacgccctgatcatcgccgcgagtagccagctccggctgtggaagaagcagaacaacccgctgatcacctacaaggagggccagttcgtcgactcccagaccggggagatcatcagcctcacggacgacgagtacaaggagctggtgttcaaggccccctacgaccacttcgtggacaccctccattctaagacctttgaggacggcatcctcttcagctaccaggtcgactccaagtacaaccgcaagatcagcgacgccaccatctatgcgacgcggaaggccaagctggacaaggacaagtccgaggagacctacgtgctggggaagatcaaggacatctacagccaagcgggctacgatgccttcatcaagatctacaacaaggacaagcgcaagttcctcatgtaccacaaggacccccagaccttcgagaaggtgatcgaggagatcctgcggacctacccctccaaggagcgtaacgacaagaacaaggaggtcccgtgcaaccccttcgagaagtaccggcaggagaacgggcccatccgcaagtacagcaagaaggggaacggccccgagatcaagtgcctgaagtactacgacaataagctcgggaactatatcgacatcagccctgacggctccgacaaccaggtggtcctgcagagcctgaagccctggcggacggacgtctactttaaccaccagaccaaggagtacgagctcatggggctgaagtactccgacctgagcttcgagaagggctccggcaagtacagcatttccaacgagaaatacaacagcatcaagcgcatcgagggggtgaacgagcagtccgagttcaagttcaccctctacaagaacgacctgatcctgatcaaggacagcgagaacaacgagcagaagctgttccggttcaactcccgcaacgacaccgccaagcactacgtggagctcaagccctacgacaaggcccggttcgacggccagcaggagctgatcaccatcctcgggaacgtcgccaagggcgggcagtgcctgaagggcctgaacaagagcaacatcagtatcttcaaggtgaagaccgacgtgctcggcaagaagcacatcatcaagaaggagggggacgagcccaagctgaagttctga

SEQ ID NO: 7431 - RNA, 3366 nt, synthetic construct
  misc_feature 1..3366: note = Cas9 variant
  source 1..3366: mol_type = other RNA
atggcagacaaaaccctaggggccctcacattcggattcgacatagggatagcatccgtcggctggtgcgtactcggcgaaaatagaatcgtcgatctcggagtccgagcgttcgacaaagccgaaacggcgaaagaaggagaatccttgaatctggcgcgacgaactgcccgcctaatgcgcagaagattacgacgtagagcgtggaggctcacaaaactcgcgaggcttttaaaacgcgaagggctaatcgccgacgccttccagatgcaccaaccctcagcgaccagcccctggaaactacgcgttgaagccctcgatagaagactgacagacgacgaatgggccagggtaatataccacctgtgcaagcaccgaggattccactggataagccgagcagaagaaaagaaagccgaaggtgatgccaaaggagagtcaggacgagtcaaaaagggcctaagcgacacacaacgccggatgggcgagaaaggctaccgaagcgcagcagaaatggttctagccgagttccccgaagcccagagaaacaaacagggagactatggcaaagccctctcacgggtactactaagcgaagaactagctctactattccggagacagagagaactcggccatacacacgcctcaaaagaactggaagcagcaattctcggaaacggagacagaaaaggcggactgttctgggcacaaaaaccaccactcgcaggagcggacctactcaaaatgctaggaaagtgcacattcgaaaaagacgaatacagagcgccaaaagcctcattcaccgcagaacgccacgtatggctaacaagacttaacaacctccgagtagtcgtcgacgggacaacacgccccctaaccgaggacgaaagacgcgtagctctaccgctaccatacggctacgccgatgcaaaattaacctacaagcaactccgagcagccctcagcaaagcaggactctcaaacttctccttcgccggtatcgccgatgacaaagagaaagacacacttaccaaactaccagcctgggaaacgctatcgaaaacactcaaaggcaaaggcttagaaacagaatgggaaggaatggcaggcgcagccacaggaggcgacccaactctattagacgagatctcacgcgtcctcagcgtttataaggacggcgacgaggtagacgtagaactcagaaaattgcccttgccaggaggcgagaaaatggtagaaaccctttcagaaatcagcttcgacaaattccacgcactaagcctgaaggcgctaaggaagatagtgccgcacatggaaacaggtttaagatatgacgaagcatgcgctgcagcagggtaccaccacagccaactccacgaagcaggagcaggcgggcaaaaatatttgccaccattctacacccggcgtgacaaagacggccgaatggtattcgatgaagaactagatgtcccacgaaaccccgtcgtcctccgagccctcaaccaagcacgcaaggtacttaacgcactggtacgagcctacggaagcccgagcgcagtgcacatagaaatggcccgcgacctctcaaaacccctagtcggccaccccacaccgaacggcggctacatcgaaggacggcgggacatagaaaaactccaaaaggagtaccgcgaaagaaacgagaaagacaaagcggcattcgccgccgaacacgggattgcagcaaaatccagggagttcgaaaaatttcaactctaccgcgaacagcaaggtaaatgtgcctactcgcttaagcccttagacctccaccgcgtgctccacgacataggctacgcagaagtcgaccacgccctcccatattcgcgaagctacgacgacggtaaaaacaacaaggtcctagtactcaccgaagaaaaccggaataagggaaaccgtaccgcctacgaatatctctgcgccttcccaggcggcgaaaatggtgagcgctggcgaaacttcgtcgcttacgtagaatccaacaaatcttatcgcctggcgaagagaactagactcctcagaaaggacttcggagggaaagccgcagaagagttcagagaaaggaacctgaacgacacacgctacatatgcaaattcttcaaaaacttcgtagaaagattcctgcaactaaaagtcggcgccgacggcacagccgcaaaaagatgcgtggtcctgtccggccaaacaaccgctttcctacgggcccgttggggactactcaaagtaagaggagcaagcgatcgacaccacgccctcgacgccgcagtcgtggccgcctgcagccacggcatggtcaaaaggctggcggactacagcaggaccaaggaactggcaaaagtacgcgatgggttccccgacccagaaacaggagaaatcgtagacccagcaatgttccaacaactacacgcccacttcccagacccctggcctcatttccgtggcgaactcgaagcccgcctacagctagacgactcagcagagctcagagcacagctagaaatgttcggcacatacccggcagaagccctagagacccttagaccgctattcgtctcccgcgcccctcaacgccggaatggaggcgcagcccataaagaaacgatctacgcccaacctgagcgcctcaaagaacaaggaggtgtaacacaaaaagtctccttagcaagtctcaagccaaccgacatcgacaaactcatcgacccgcacagaaacgagaaactctacgccgcaatccgagcaaggttagaagcacacggcggcaaaagcgacaaagcctttccagccgacaaccccctgcggaaacctgaccgtgacggtaatccgacaggcccgatcgtacgagccgtcacaatggtcatcgacaaactgagtggcattcaaatccgcggaggaatcgccaaaaacgacacaatgctccgagtcgacgtatttcggcacaagaaagacggaaaattccacctagtcccactatacgtgcaccacgcagtcgcccaagaactccccaaccgtgccatcgtcgcgttcaaagacgaagacgaatggaccttgatagacgacaacttccacttcctattctccttccacccaaatgacttcatacggataacgcagaaaaataaagcgccaatactcggctactacgccagctgccacagaggaacaggaaacctcaacctctgggcccacgacagaaaccaaaaagtcgggaaagatggacaaatcgaggggatcggagtaaagacggcggtggccctcgaaaaattccatgtcgacgtcctcggcaacatctacccagccccgcccgaacaaagacacggactagcctga

SEQ ID NO: 7432 - RNA, 3366 nt, synthetic construct
  misc_feature 1..3366: note = Cas9 variant
  source 1..3366: mol_type = other RNA
atgagcgacctcgtgctgggcctggacatcgggatcggctccgtcggggtgggcatcctgaacaaggtgaccggggagatcatccacaagaatagccgcatcttccccgccgcccaggcggagaacaacctcgtccggcgcaccaaccggcagggcagacggctgacgcgccggaagaagcaccgccgggtgcggctgaaccgcctcttcgaggagtccggcctgatcaccgacttcaccaagatcagcatcaacctgaacccgtaccagctccgggtgaaggggctgaccgacgagctgtccaacgaggagctgttcatcgccctgaagaacatggtcaagcaccggggtatcagctacctggacgacgcctccgacgacgggaacagctccgtcggcgactacgcccagatcgtgaaggagaacagcaagcagctcgagacgaaaacccccgggcagatccagctggagcgctaccagacctacggccagctgcggggcgacttcaccgtcgagaaggacgggaagaagcaccgcctcatcaacgtgttccccacgtcagcctaccggagcgaggcgctgcgcatccttcagacccagcaggagttcaacccccagatcaccgacgagttcatcaaccggtacctcgagatcctgaccggcaagcgcaagtactaccacgggccgggcaacgaaaagtcccggactgactacggccgctaccgaactagcggggagactctggataatatcttcggcatcctcatcgggaagtgcaccttctaccccgacgagttccgggccgccaaggcctcctacacggcgcaggagttcaacctgctgaacgacctcaacaacctgaccgtgcccaccgagaccaagaagctgagcaaggagcagaagaaccagatcatcaactatgtcaagaacgagaaggccatgggccccgccaagctgttcaagtacatcgccaagctcctgtcctgcgacgtggccgacataaaggggtaccgcatcgacaagagcggcaaggcggagatccacacgttcgaggcctaccggaagatgaagacactcgagaccctggacatcgagcagatggaccgcgagaccctggacaagctcgcctacgtgctgacgctgaacaccgagcgggagggcatccaggaggccctcgagcacgagttcgccgacgggtccttcagccagaagcaagtcgacgagctggtgcagttccgcaaggcgaatagctccatcttcggcaaggggtggcacaacttctcggtgaagctgatgatggagctcatcccggagctgtacgagacctccgaggagcagatgacgatcctgacgcggctcggcaagcagaagaccaccagctccagcaacaagaccaagtacatcgatgagaagctgctgacggaggaaatctacaaccccgtcgttgccaagtccgtacgccaggccatcaagatcgttaacgccgccatcaaggagtacggggacttcgacaacatcgtgatcgagatggcgcgggagaccaacgaggacgatgagaagaaggccatccagaagatccagaaggccaacaaggacgagaaggacgccgccatgctcaaggcggccaaccagtacaacggcaaggccgagctgccccacagcgtgttccacggccacaagcagctggccaccaagatccgcctgtggcaccagcagggggagcggtgcctctacacaggcaagacgatctccatacacgacctgatcaacaacagcaaccaatttgaggtcgaccacatcctgcccctctccatcaccttcgacgactctctggcgaacaaagtgctggtctacgccaccgccaaccaggagaaagggcagcgcaccccgtaccaggccctcgactccatggacgacgcctggagcttccgggagctgaaggcgttcgtgcgcgagtccaagaccctgagcaacaagaagaaagagtacctcctgacggaggaggacatctccaagttcgacgtgcggaagaagttcatcgagcgcaacctggtcgacacccggtacgccagccgcgtggtgctcaacgccctgcaggagcacttccgggctcacaagatcgacaccaaggtctccgtggtgcgcggccagttcaccagccagctgcgccgtcactgggggatcgagaagacgcgcgacacctaccaccaccacgccgtcgacgcgctcattatcgccgccagctcccagctgaacctgtggaagaagcaaaagaacaccctcgtgagctactccgaggaccagctgctggacatcgagacgggcgagctcatcagcgacgatgagtacaaggaatccgtgttcaaggccccctaccaacacttcgtcgacacgctcaagagcaaggagttcgaggactccatcctgttcagttaccaggttgactcaaagttcaaccggaagatcagcgacgccaccatctacgcgacccgccaggcgaaagtgggcaaagacaaggccgacgagacctacgtcctcgggaagatcaaggacatctatacgcaggacggctacgacgccttcatgaagatctacaagaaggacaagtcaaagttcctgatgtaccggcacgacccacagaccttcgagaaggtgatcgagcccatcctggagaactaccctaacaagcagatcaacgagaaggggaaggaggtgccctgcaaccccttcctcaagtacaaggaggagcacggctacatccgcaagtactcaaagaagggcaacgggcccgagatcaaatccctaaagtattacgacagcaagctgggcaaccacatcgacatcaccccgaaggactccaacaacaaggtcgtgctccagagtgtgtccccctggcgggcggacgtctatttcaacaagaccacggggaagtacgagatcctcggcctgaagtacgccgacctccagttcgagaaggggaccggcacctacaagatcagccaggagaagtacaacgacatcaagaaaaaggagggcgtggactccgactccgagttcaagttcaccctgtacaaaaacgacctgctcctggtgaaggacacggagaccaaagagcagcagctgttccgcttcctcagccggaccatgcccaagcagaagcactacgtcgagctgaagccctacgacaagcagaagtttgagggcggggaggcactgatcaaggtgctcgggaacgtggccaactccggccagtgcaagaaggggctgggcaagagcaacatctccatctacaaggtccgcaccgatgtactgggcaaccagcacatcataaagaacgagggggacaagccgaagctcgacttctga

SEQ ID NO: 7433 - RNA, 3366 nt, synthetic construct
  misc_feature 1..3366: note = Cas9 variant
  source 1..3366: mol_type = other RNA
atgaacggcctggtgctcgggctagacatcggcatcgggagcgtcggcgtgggtatcctgaacaaggacaccggcgagatcatccacgccaactcccgcatcttccccgccgcgaccgccgacaacaacgtggtccggcgcagctcccggcagggccgccggctcaaccaccgcaagaagcaccggagcgtgcgcctgaaggacctgttcgagtactacgacctcctgacggacttctccaaggtgagcataaacctgaacccgtacagactccgcgtcgacgggctgaaccagcagctgaccaacgaggagttgttcatcgccctcaagaacatcgtgaagcggcgcggcatctcttacctggacgacgccagtgaggacgggggcgccgtgtccagcgactacgggaaggctgtcgaggagaaccggaagctccttgccgagcagaccccaggccagatccagctggagcgcttcgagaagtacggccaggtgcgcggggacttcaccgtggtcgagaacggcgagaagcggcggctcatcaacgtgttttccacgagcgcctacaaaaaggaggccgagcgcatcctgcggaagcagcaggagtacaacaaccagatcatggacgagttcatcgcggactacctgaccatcctcaccgggaagcgcaagtactaccacggccccggcaacgagaagtcacggaccgactacgggcgcttccgcacggacggcaccaccctggacaacatattcgggatcctgatcggcaagtgcaccttctaccccgaggagtaccgggccagcaaggcctcctacacggcccaggagttcaacctcctgaacgacctgaacaacctcactgtgccgaccgagaccaagaaactgagcgaggagcagaagaagacgatcgttgagtatgccaagtccgcgaagaccctgggggctagcaccctcctgaagtacatcgccaagatgatcgacgcctccgtggaccagatccgcggctaccgggtggacgtcaacaacaagcccgagatgcacaccttcgaagtgtatcgcaagatgcagctgcttgagacgatccccgtgggcgagtttagccgggaggtcctggacgagctggctcacatcctcaccctgaacaccgagcgcgaggggatcgaggaggcgatcaacaccaagctgatggacgtgttcagccaggaccagatcctcgagctggtgcagttccggaagaacaactccagcctgttctccaagggctggcacaacttcagcctcaagctgatgatcgaactgatccctgagctctacgaaacgtccgaggagcagatggccatcctgacccgcctggggaagcagaagttcaaggagacaagcaagcggaccaagtacatcgacgagcaggaggtcacggaggagatctacaacccggtggtcgctaagtccgtgcgccaggccatcaagatcatcaacgaggccaccaagaagtacggcatcttcgacaacatcgtgatcgagatggcgcgggagaacaacgaggaggaggccaagaaggactacatcaagcgccagaaggccaaccacgacgagaagaacgccgccatggagaaggcggccttccagtacaacggggagaaggagctccccgacagcatcttccacggccacaaggagctggcaaccaaggtccggctgtggcaccagcagggcgagaagtgcctgtacaccgggaagaacatccccatctccgacctcatccacaatcagtacaagtacgagatcgaccacatcctgcccctgagcctctccttcgacgacagcctgtccaacaaagtgctggtgctcgccacggcgaaccaggagaagggccgccggaccccgttccaggccctggacagcatggacgacgcctggtcctaccgcgagttcaagagctacgtcaaggactccaagtctctggggaacaagaagaaggactacctcctgaccgaggaagacatctccaagatcgaggtgaagcaaaagttcatcgagcggaacctggtggacactcgctacagtagccgggtcgtgctcaacacgctgcaggacttctacaaggcccacaagttcgacaccacaatctccgtggtccgcggccagttcaccagccagctgcgccggaagtgggggctcgagaagtcccgcgagacctaccaccaccacgccgtggacgcgctgatcatcgccgccagctcccagctgcggctctggaagaagcagaacaaccccctgatcagctacaaggagggccagttcgttgactccgagacgggcgagatcatcagcctgaccgatgacgagtacaaggagctcgtctttaaggccccctacgaccacttcgttgacaccctgcgctccaagaaattcgaggacagcatcctgttctcctaccaggtggacagcaagttcaaccggaagatctccgacgccaccatctacgccacgcgcaaggccaagctcgacaaggacaagagcgaggagacctacgtcttagggaagatcaaggacatctactcccagagcggctacgacgccttcatcaagatctacaacaaggacaagtccaagttcctcatgtaccacaaggacccccagaccttcgaaaaggtgatcgaggagatcctccggacctacccgtccaaggagttcaacgaaaagaacaaggaggtgagctgcaaccccttcgagaagtacaagcaggagaacgggcccatccgcaagtactccaagaagggcaacggccccgagatcaagagcctgaagtactacgacaagaacatcccggagtccttcatcaacatcacgcccagcaactccaagaacaaggtcatcctgcggcagctcaacccttggcgcaccgacgtgtacttcaaccaccagaccgagaagtacgagctgctggggctcaagtacgccgacctccagttcgagaagaagactggcacgtacagcatcaccattgacaagtacaacgagatcaaggagaaggagggggtgtccgagcacagcgagttcaagttcaccctgtacaagaacgacctcctgctgatcaaggacaccgagatcaaggaggagcagatcttccggttcttatcccgcacgatgcccaaccagaagcactacgtcgagctaaaaccgtactacaagggcaacttcgaggggaaggagcggatcaaggtgttcaacaccaccagcaacggccgctgcctgaaaggcctccggaagaaggggctgtccatatacaagatcaaaaccgacgtgctgggcaacaagcacttcatcaagaaggaaggggagaagcccaagctcaagttctga

SEQ ID NO: 7434 - RNA, 3369 nt, synthetic construct
  misc_feature 1..3369: note = Cas9 variant
  source 1..3369: mol_type = other RNA
atgaacggcaaaatcctaggtctcgacatcggcgtagcctccgtcggcgtgggcatcctggacaagaagaccggagaaatcatccacgcctctagccgcatattccccgcggccaccgccgactccaacgtggagcggagaggctttcggcaggggcgcaggctcggtcgcagaaagaagcaccgaaaggtccggctcgccgacctgttctctgacacgggtctgatcacggacttctccaaggtgagcatcaacctcaatccatacgagctgcggatcaagggactaaacgagaagctcaccaacgaggaactgttcatcgccctgaagaacatcgttaaacggcgcggcatctcctacctcgacgacgcgaatgaagacggggagagctccagctccgagtatggcaaggcggtcgaggagaaccggaagctgttagccgacaaaaccccgggacagatacagctcgagcgcttcgagaagtatgggcaagtccgtggcgactttacgatcgaggaaaacggggagaagcaccgcctgctgaacgtgttttccacctccgcctataagaaggaggcagaacggatactcaccaagcagcaggattacaaccaggacatcaccgacgagttcatccaggcctacctgacgatcttgaccggcaagcgcaagtactaccacggccctggtaacgagaaatctcgtaccgactacggccgcttccggaccgacgggacgacgctcgacaacatcttcggcatactgatcggaaagtgcaccttctaccccgaggagtaccgcgccgccaaggcctcctacacagcgcaagagttcaacctgctcaacgatcttaataacctgaccgtgccgaccgagaccaagaaactcagcgaggaacagaaacggcagatcatcgagtacgccaagggcgccaagaccctgggggccgccacgctgctcaagtacatcgcgaagctggttgacgggtcggtggaggatattaaaggctaccggatcgataagagtgaaaagcccgagatgcacaccttcgacatctaccggaagatgcagaccctggagaccgtagacgtggagaagctctcccgggaggtgctggacgagttggcccacatcctcacgctgaataccgaacgggagggcatcgaagaggccatcaaggtctccttcatcaagcgggagtttgagcaggaccagatcgcagagctggtgagcttccgcaaatccaacagctccctcttcggcaaggggtggcataacttcagcatcaagctgatgacagagctgatacccgagctctacgagacctccgaggagcaaatgacgatcctgacccgcctgggcaagcaaaagaccaaagcccgcagcaaacggaccaagtacatcgacgaaaaggagctcacagatgagatctacaacccagtggtcgcaaaatccgtgcgacaggccatcaaaatcatcaaccttgccaccaagaagtacggggtgttcgacaatatcgtcatcgagatggcccgggagaacaacgaggaggacgcaaagaaggactacgtgaagcgccaaaaggcgaacgaagatgagaagaacgccgccatggaaaaggccgcgcaccagtacaacgggaagaaggagcttccggacaatgtgttccacggccacaaggagctcgcaaccaagatccggctgtggcaccagcagggggagaagtgcctgtacacaggcaagaacatccccatctcggatcttatccacaaccaatacaagtacgagatagaccacatcctccccctgtccctcagcttcgacgactccctagctaacaaggttctggtgctggccacggccaaccaggaaaaggggcagcgcacaccctttcaggccctagacagcatggatgacgcctggagctaccgggagtttaaggcctatgtccggggcgcccgggccctgagcaacaagaaaaaggactatctgctcaacgaagaggacatcaacaagatcgaagtgaaacagaagttcatcgagcgcaacctggtggacacccgttactccagccgcgtcgtgctgaacgcgctccaggacttctacaaactgaacgacttcgacaccaagatcagtgtagtccgcggccagttcacctctcagctgcggcgcaaatggcggatcgacaagagccgcgagacgtaccaccaccacgccgtggacgcgctcatcatcgccgccagcagccagctgcgcctgtggaagaagcagggcaacccattgatctcctataaggagaaccagttcgtcgacagcgagaccggcgagatcatttccttgaccgacgacgagtacaaggagctggtcttccgggcgccctacgaccacttcgtggacaccgtaagctcaaagaaattcgaggaccggatcttgttcagctatcaggttgactccaaatacaaccgcaagatcagcgacgccactatctactccacacggaaggccaaactgggtaaggacaagagcgaggagacctacgtcctagggaagatcaaggacatctacacccagacaggctacgacgccttcatcaagctgtacaagaaggacaaatccaaatttctcatgtaccacaaggaccccatcacattcgagaaggtaatagaggaaatcctgaaaacctaccccgacaaggagatcaacgagaaggggaaagaggtcgcgtgcaacccctttgagaagtaccgccaggaaaacggcccacttcggaaatacagtaaaaaggggaagggccccgagatcaaatccctgaaatactacgacaacaagctcgggaatcatatcgacatcacgcccgacaacagcgagaaccaagtgatcctccagtccctgaagccgtggcgaacggatgtgtactttaaccacaagaccaagatctacgagctgatgggcctcaagtacagcgacctgtccttcgagaagggtagcgggaagtaccggatcagccttgacaagtataacgtcatcaagaagaaggaaggcgtgcataaggagtccgagttcaagttcaccctgtacaagaacgacctgatcctgatcaaggatctcgaaaagtccgagcagcagctgttccgctacaacagccggaacgatacatccaagcactacgtggagctgaaaccctacgacaaggcaaagttcgaggggaaccagcccctcatggccctgtttggcaacgtcgccaagggcgggcaatgcctgaaaggcctcaacaaggccaacatctccatctacaaggtacagaccgacgtcctggggaacaaacggttcatcaagaaagagggcgacgcgcccaaactggagttctga

SEQ ID NO: 7435 - RNA, 3369 nt, synthetic construct
  misc_feature 1..3369: note = Cas9 variant
  source 1..3369: mol_type = other RNA
atgagcgacctggtgctcggcctggacatcgggatcggatccgtcggggtgggcatcctgaacaaggtgaccggggagattatccacaagaacagtcgcatattccctgccgcccaggcggagaacaacctcgtccggcgcaccaaccggcagggccgccggctgacccgccggaagaagcaccgcatcgtgcggctgaaccgcctgttcgaggagtccggcctgatcaccgacttcaccaagatcagcatcaacctgaacccgtaccagctccgggtgaaggggctgacagacgagctgtccaacgaggagctgttcatcgccctcaagaacatggtcaagcaccgcggcatcagctatctcgacgacgcctccgacgacgggaacagctccgtgggcgactacgcccagatcgtgaaggagaacagcaagcagctcgagacgaagacccccgggcagatccagctggagcggtaccagacctacgggcagctgcgcggcgacttcaccgtcgagaaggacgggaagaagcaccggctcatcaacgttttccccacgtccgcctaccgcagcgaggcgctgcggatcctgcagacccagcaggagttcaactctcagatcaccgacgagttcatcaatcgctacttagagatcctgaccggcaagcggaagtactaccacgggcccggcaacgagaagtcacgcaccgactacggccggtatcgcactaacggggagaccctggacaacatcttcggcatcctcatcgggaagtgcaccttctacccggacgaatttcgcgccgcgaaggccagctacacggcgcaggagttcaacctgttaaacgacctcaacaacctgaccgtgcccaccgagaccaagaagctgagcaaggagcagaagaaccagatcatcaactacgtcaagaacgagaaggtgatgggccccgccaaacttttcaagtacatcgccaagctcctgtcctgcgatgtggccgacatcaaggggcaccggatcgataagagcggcaaggccgagatccacacgttcgaggcgtaccgcaagatgaagaccctcgagaccctggacatcgagcagatggaccgggagaccctggacaagctcgcctacgtcctgacgctgaacaccgagagagagggcatccaggaggccctcgagcacgagttcgccgacgggtccttcagccagaagcaggtcgacgagctggtgcagttccggaaggcgaacagctccatcttcggcaaggggtggcacaacttcagcgtgaagctgatgatggagctcatccccgagctgtacgagacctccgaggagcagatgaccatcctcacgcgcctgggcaagcagaagaccaccagctccagcaacaagaccaagtacatcgacgagaagctgctgacggaggagatttacaacccggtggtggcgaagagtgtccggcaggccatcaagatcgtgaacgccgccattaaggagtacggggacttcgacaacatcgtgatcgagatggctcgcgagaccaacgaggacgacgagaagaaggcgatccagaagatccagaaggccaacaaggacgagaaggacgccgccatgctcaaggccgcgaaccagtacaacggcaaagccgagcttccccacagcgtcttccacggccacaaacagttagccaccaagatccggctgtggcaccagcagggggagcgctgcctctacaccggcaagacgatctccatccacgacctgatcaacaaccccaaccagttcgaggtggaccacatcctgcccctctccatcaccttcgacgactccctggccaacaaggtcctggtgtacgcgaccgccaaccaggagaaggggcagcggaccccgtaccaggccctcgacagcatggacgacgcttggtccttccgcgagctgaaggccttcgtgcgggagagcaagaccctgtccaacaagaagaaggagtacctcctgacggaggaggacatcagcaagttcgacgtccgcaagaagttcatcgagcggaacctggtggacacccgctacgcgtcccgggtggtcctcaacgccctgcaggagcacttccgcgcccataagatcgacaccaaggtgagcgtggtccggggccagttcacgtcacagctgcgccgccattgggggatcgagaagacgcgggacacctaccaccaccacgccgtggacgccctcatcatcgcggccagcagccagctgaacctgtggaagaagcagaagaacaccctcgtgtcctacagcgaggaacagctgctggacatcgagaccggcgagctcatctccgacgacgagtacaaggagagcgtcttcaaggccccctaccaacacttcgtcgacacgctgaagtccaaggagttcgaggacagcatcctgttctcctaccaggtggacagcaagttcaaccgcaagatctccgacgccacaatctacgccacccggcaggcgaaggtcggcaaggacaagaaagatgagacctacgtgctcgggaagatcaaggacatctacacgcaggacggctacgacgcctttatgaaaatctacaagaaggacaagagcaagttcctgatgtaccgccacgacccccagaccttcgagaaggtgatcgagcccatcctggagaactacccgaacaaggagatgaacgagaaggggaaggaggtcccctgcaacccgttcctcaagtacaaggaggagcacggctacatccggaagtactccaagaagggcaatgggcccgagatcaagagcctgaagtactacgactccaagctgctcggcaacccgatcgacatcacccccgagaacagcaagaacaaggtggtgctccagtccctgaagccctggcgcaccgacgtctacttcaacaagaacacgggaaaatacgagatcctcggcctgaagtacgccgacctgcagttcgagaagaagaccgggacctacaagatcagccaggagaagtacaacggcatcatgaaggaggagggcgtggactccgacagcgagttcaagttcaccctctacaagaacgacctgctgctcgtgaaggacactgagaccaaggagcagcagctgttccggttcctgagccgcaccatgcccaacgtcaagtactacgtggagctcaaaccgtactccaaggacaagttcgagaagaacgagagcctgatcgagatcctggggtccgccgacaagagcggccgctgtatcaaagggctcggcaagtccaacatcagcatctacaaggtgcgcacagacgtcttggggaaccagcacatcatcaagaacgagggcgacaagcctaagctggacttctga

SEQ ID NO: 7436 - RNA, 3369 nt, synthetic construct
  misc_feature 1..3369: note = Cas9 variant
  source 1..3369: mol_type = other RNA
atgagcaacggcaagatcctggggctcgacatcggcatagcctcagtgggggtcggcgtgatcgacgcccagaccggggagatcatccacgcgagctcccgcatcttccccagcgctaacgccgctaacaacgcggagcggcgcaccttccggggctcccgccggctgatccgccggaagaagcaccgcatcaagcggctggacgacctcttcaacgacttccacatcaacctggacggcgagatgagcacggacaacccgtacgttctgcgcgtcaaggggctcagtcaaaagctgaccgtggaggagctgtacatcagcatcaagaacatcatgaagcggcgcggcatatcctacctcgacgacgcggaaagcgacaatgaagccgggcggtccgattacgcaaaggccatcgagcgcaaccgacagctgctgaccagcaagacccccggcgagatccagctcgagcgcctggagaagtacggtcagctgcggggcaatttcacaatcatcgacgaggagggacagtcccagcaaatcattaatgtgttctccacctcagactatgtcaaggaagtagagaagatcctggactgccagaagatgtaccataagttcatctcggacgagttctgcgacaagctgatagagttactccgcgagaagcggaagtactacgtggggcctggcaacgagaaatcccgcacagattacgggatttaccggaccgacggcacgaccttagagaacctgttcggcatcctcatcgggaagtgcacattctaccccgaccaataccgcagctcccgcgcgagctacaccgcccaggagttcaacttcctgaacgatctgaacaacctcacggtcccgaccgagaccaagaagctatcgcaggagcagaaggagttcctggtgaattacgccaaggaaacctccgtgctcggcgccgggaagatcttacaacagatcgccaagttggcggactgcaaggttgaggacatccgggggtaccgcctcgacaacaaagacaagcccgagctgcacatcttcgagacctaccgggccatgaagggactggtgcctctcgtggacatcggcgtcctgtcccgcgagcagctcgacatactcgcggacatcctgaccctgaataccgacttcgagggaatccgggaggccctcaagaagcagctgcccaacgtgttcgacgagaagcaggtcaaggggctggcctccttccgcaagagcaagtcccagctgttcgcgaagggctggcataacctcagccaaaagatcatgctggaagttatccctgagctctacgccacctccgacgagcagatgacgatcctgaccagactgggcaagttcgagaagtccagcgtggccgagtaccccagctccatcaacgtcgacgagatcaccgacgagatctacaaccccgtcgtggccaagagcatccgccagactatcaagatcatcaacgcctccatcaagaagtggggtgagttcgaccagatcgtgattgaaatgccccgggaccgcaatgaggacgaagagaagaagcggatcgcggacgggcagaaggcgaacgccaaggaaaaggccgatagcatcctccgcgccgcggaactgtattgcgcgggcaaggtactgccggactacgtgtacaacggccacaaccagctggccacgaagatcaggctctggtaccagcagggggagcgctgcatctacaccggccagcccatctccattcacgacctgatccacaaccagaaccagtacgagattgaccatatcctgcccttaagcctgacctttgatgactccctgagcaacaaggtcctcgtgctggcgaccgcgaaccaggagaaggcccagagaacgccctacaattacctgaagtccgccaccagcgcctggagctaccgcgagttcaaggactacgtgaccaagcggaaagggatcggcaagaagaagtgcgagtacctcaccttcgaggaggacatcaacgggttcgaggtccgctcaaagttcatccagcggaacctggtggacacgcgctacgcctcaaaggtgatcctgaacgccctccaggactactttaagatcagcggcatccagaccaaggtcagcgtggtgcgcggccagttcacctcccagctgcggcacaagtgggggatcgagaagacccgcgagacgtatcaccaccacgccgttgacgccctgatcattgccgccagctcccagctccggctgtggaaaaagcaggagagcccgttagtggtggactaccaggagggccgccaggttgacctagagaccggggagatcctggagctgaccgacgagcagtacaaggagctcgtgtaccagccgccctaccagggcttcgtgaacacgatctctagctccgcgttcgacaacgagatcctgttcagctaccaggtcgactcgaaggtgaaccggaagatcagcgacgcgactatctacgccacgcgcaacgcccagctgggcaaagacaagaccgaggggatctacgtgcttggcaagataaaggacatctacacccaggccgggtacgaggcgttcctgaagcggtacaccaaggacaagacctccttcctgatgtaccacaaggacctcgacacctgggagaaggtcatagaaatcatcctgcgcgactaccgggagtacgacgagaagggcaaggagatcgggaacccgttcgagcgctaccggcgcgagaacggctacgtaaagaagtacagccggaagggcaacgggaccgccatcaagtccttgaagtactacgacaacaagctcggcaatcacatcgacatcacccctgagaacagccgcaacgccgtggtcctgcaaagcctgaagccttggagaacggacgtgtacttcaacaaggagaccgggaagtacgagttccttggcatcaagtactccgacctgagcttcgagaaggggactggcgagtatggcatctcccaggaaaagtacgacagcatcaagatcgccgagggggtggctaagaagtccatcttcaagttcaccctgtacaagcaggacctcctgttcataaaggacatcgagaacaacttcggcaagctgctccgcttcaccagcaaaaacgacacctccaagcactacgtggagctcaagccctacgacaaaaacaaattcgggaccgaggagcccttgctcccagtgctgggcaacgtggccaagagcgggcagtgcatcaagggcctgaacaagtccaacatctctatctacaaagtccggaccgacatcctcggctaccgccacttcatcaagcaggagggggagcacccccagctgaagttcaagaagtga

SEQ ID NO: 7437 - RNA, 3369 nt, synthetic construct
  misc_feature 1..3369: note = Cas9 variant
  source 1..3369: mol_type = other RNA
atgagcaacggcaagatactggggctcgacatcggcatcgcctccgtgggggtcggcgtgatcgacgcccagaccggggagatcatccacgcgtcttcccgcattttcccaagcgccaacgccgccaacaacgccgagcggcgcaccttccggggctcgaggcggctgatccgccggaagaagcaccgcatcaagcggctcgatgacctctttaacgacttccacatcaacctggacggcgagatgagcacggacaacccatacgtgctgcgcgtcaaagggctctcccagaagctgaccgtggaggagctgtacatcagcatcaagaacatcatgaagcggaggggcatctcctaccttgacgacgcggagagcgacaacgaggccgggcggtccgactacgcgaaggctattgagcgcaaccggcagctgctgacaagcaagacgcccggcgagatccagctcgagcgcctcgagaaatacgggcaactgcggggtaacttcacgatcatcgacgaagagggccagtcccagcagatcatcaacgtgttcagcacctccgactacgtcaaagaggtggagaagatccttgactgccagaagatgtaccacaagtttatcagcgacgagttctgcgacaagctgattgagctgctccgcgagaagcggaaatactacgtggggccgggcaacgagaagtcccggaccgactacgggatctaccggaccgacggtacgaccctggaaaacctgttcggcatcttaatcgggaagtgcaccttctaccctgaccagtaccgcagctcccgcgcgagctacaccgcccaggagttcaacttcctaaacgacctgaacaacctcacggtcccgaccgagacgaaaaagctgagccaggagcagaaggagttcctggtgaactacgccaaggaaacctccgtgctcggcgcagggaagatactgcagcagatcgccaaactggcggactgcaaggtcgaggacatccggggctaccgcctcgacaacaaagacaagcccgagctgcacacgttcgaaacgtaccgagccatgaagggtctcgtgcccctcgtggacatcggcgtcctgagccgcgagcagctggacatccttgccgacatcctgaccttaaacacggacttcgagggcatccgggaggccctcaagaagcagctgcccaacgtgttcgacgaaaagcaggtcaaggggctggcctccttccgcaagagcaagtcccagctgttcgctaagggctggcacaacctcagccagaagatcatgcttgaggtgatcccggagctgtacgccacgtccgacgagcagatgaccatcctgactcggctggggaagttcgagaagtccagcgtggccgagtacccatcgtccatcaacgtcgacgagatcaccgacgagatctacaaccccgtcgtggccaagagcatccgccagacgatcaagattatcaacgcctccatcaagaagtggggcgagttcgaccagatcgtgatcgagatgccccgggatcgcaatgaggacgaagagaagaagcggatcgcggacgggcagaaggccaacgccaaggaaaaggccgacagcatcctccgtgccgcagagttatactgcgccggcaaggtcctgccggactacgtgtacaacggacacaaccagctggccaccaaaatccggctctggtaccagcagggagaaaggtgcatctacaccggccagcccatctccatacacgacctgattcacaaccagaaccagtacgaaatcgaccacattctgcccctcagcctgactttcgacgactccttgagcaacaaggtcctcgtgctggcgacagcgaaccaggagaaggcccagcggaccccctacaactacctgaagtccgcgaccagcgcctggagctaccgcgagttcaaggactacgtgaccaagcggaaggggatcggcaagaagaagtgcgagtacctcacgttcgaggaggacatcaacgggttcgaggtccgctccaagttcatccagaggaacctggtggacacccgctacgccagcaaggtgatcctgaacgccttgcaggactacttcaagatctccggcatccagaccaaggtcagcgttgtgcgcggccagttcacctcccagctccggcacaagtggggaatcgagaagacgcgcgaaacctaccaccaccacgccgtcgacgccctgatcatcgccgccagctcccaactccgcctgtggaaaaagcaggagagcccgctggtggtagactaccaggaggggcgccaggtcgacctcgagaccggggagatcctggagctgaccgacgagcagtacaaggagcttgtgtaccagccgccctaccagggcttcgtgaacaccatttccagctccgccttcgacaacgagatcctgttcagctaccaggtcgactccaaggtgaaccggaagatcagcgatgccacgatatacgccacccgcaacgctcaactgggcaaggacaagaccgaaggtatctacgtgctcggcaagatcaaggacatctacacccaggcagggtacgaggcgttccttaagagatacacgaaagacaagacctccttcctgatgtaccacaaggacctggacacctgggagaaggtcatcgagatcatcctgcgcgactaccgagagtatgacgagaagggcaaggaaatcgggaaccccttcgagcgctatcggcgcgagaacggctacgtgaagaaatactccaggaaaggaaacgggacagccatcaaatccctgaagtactacgacaacaagctcggcaatcacatcgacatcactccggagaacagccgcaacgccgtggtcctgcagagcctgaagccttggcggaccgacgtgtacttcaacaaggagaccggtaagtacgagttcctcggcatcaagtactccgacctgagcttcgagaaggggaccggcgaatacggaatctcccaggaaaagtacgacagcatcaagatcgccgaaggggtggcgaagaaatccatcttcaagttcacgctgtacaagcaggacctcctgttcataaaggacatcgagaacaacttcggcaagctgttacgcttcaccagcaagaacgacacctccaagcactacgtcgagcttaagccctacgacaagaacaaattcgggaccgaggagcccctgttgccggtgctgggcaacgtggccaagtctgggcagtgcatcaagggcctgaacaagtccaacatcagcatctacaaggtccggaccgacatcctcggctaccgccacttcatcaagcaggagggggagcacccccagctgaagttcaagaagtga

SEQ ID NO: 7438 - RNA, 3372 nt, synthetic construct
  misc_feature 1..3372: note = Cas9 variant
  source 1..3372: mol_type = other RNA
atggccaagatcctgggcctagacctgggaaccaattcgataggctgggccctgatcgacgacgtgcaaaacaagatcctcggggtcggatcccgcatcttccccatgggcgtggagaacctgggcgacggcgacggggagatcagcaagaacgcgtcccggacagggacgcgcggcgtgcggcgccaattcttccgacgccggctgcgcaagaaggtcttgctgaaggcactgagcgaaaacaacatgtgcccgatgataacatccgacttcgacaactggaagaagaccaagcagttccccagcgagaagctcgcctcctggttcgccctgaacccctacgaactgcggaataaggccctcagcgaaaagttaaccctggaagagataggccgcatcttctaccacctcatccagagaagaggttttctgtccaatagccggaagggcggcacggacgacggtgcgatcttcaaaggcaacccaaaggaggggaaaatcggcatcaccgacacccaggagtccatccaggacaaaaccctgggaagctacctcttcgagatctacccgaaggagaaccagcccttccagaatgggctggagcgcatccggaaccgctacactgtgcggaagatgtacgtggacgagttcgaaatgatctgggagaagcaggctcaatactactctaacctgaacgaagacctcaagaccctgttcggcgggcgaaagctggacggctacaaggaggacggtatcctcttccaccagcggcccctgcgcagccagaagcacctggtcggcaactgcgtgttcgagcccaacaagacaaagtgcccgatctccgctatccccttcgagcagttccgggtgtggcagtgggtcaacaccgtggagtacaacggcaagaagatcagccaggtggagaaggagaagatcgtcgagttcttatacgccaacgacaagacggacttcaagaagatcaggaaggcgatcgggaaggagtcaacggagttcaagttcaactacaaggacgacgacaagattgttggcacctacaccgtgagccacctatcaaacaagaagtacttcgggaaaaagtggttcgaatttagcgagaaggagcaggaggacatctggcacatcctgtacttcttcgacagcaagtccaacctcaaggagtacgccatcaagaactggaacttcacggaggaacaggccgagagcatcgccaagttcaacgtcaaggacggctactccagcctgtcccgcaaggccatcagcaatatcctgccctttctaaagctggggttcacctacgacgtggcggtggtcctgggtggcattaagaacgtgttcgggcacgagtgggagaagctctccgacgagaagcggaacttcctgatcgacaacgtggagggcatcgtccgcagcaagacgaagggcgggtttatcgacgtcatcaaggacatcctgcggaacgactacaacatctctgacaaccagctccgcaagctgtaccaccacagcgccaccatctatgtggccgagctgctcgagaagctgcccgtcgggaaggaggccgacaaggagatccaatccatccgtaacccgatcgtgatcacggccctgttcgagctccgcaaactggtcaacgagctgatcgacgacttcggcagcatcgacgagatcaaggtggagatggcgcgggacctcaagatttcgaaaagccagcgcaacaagatccggcgcgagcagaagcggctggaacgcgagaacgaccgggtgaaggcccgcctgctggaggagggccagaggatcacccacgacaacatcctcctgtacaagctgtgggaggagtgcaagaagacctgcccgtacaccgggaaccccatccctctctacaagctgttcacgggcgagatccagatcgagcacatccacccgtggtcccgcagcctgaatgactccttcgccaacaagactctctgctacgccgacgagaatcggaagaagggtgacaagaccccctacgagttctatggcaacgacgagagcaactggtccgccatcaaggagcgcgcgctgaagctgttcagcgacactaaggagtaccccaacgcctaccagaagtttaagcggttcgtccagcacaagttcgacgacgacttcagctcccgccagctcaacgacacgagatacatcagcaaggaggccaagaactacttatccaagatatgcaagaaggtggccgtcagccccggccaggccacctccaacctgcggcagaagtggggaatgaacaacatcctcaacgacgagaacgagaagacccgcgaggaccaccggcaccacgcgatcgatgccctcgtcatggcctgcaccaagatctcttatgtacaggagctgtccaaatggaaccgctacaaccggaacgccgagctcaagaagttcccgctgccctgggagacgttctggagcgacgcaaaccgcgccgttgacaagatcctgatctcccacaagaaggtcagcaacgacatcactggccggacccatatttctgagaagaacgggaagaagtacaaaaatgtgggcgtggcagcgcgcgggcagctccacaaggagaccgtatacggcaagcggacgttcaacggcgaggaggctttccacgtgcgcaagaccatcgatagcctgaccaccgagaagcagctggagaaggtggtcgacgagtccataaagctcctgatcaagaagcgcgtgcaggagctcgggggcttcgtgaagggcgctatccccgccaacaccttcttcgtcgtggacgagaacgggatcaagcagccccagatcttcctaccaaacaagaacggggctcccgtgcccgtcctgaaggtgcgcatgaaggagaacatcggcggcgccgagaagctgaaggagaacgtgaaccagtgggtcaacccccggaacaaccaccacgtgctcatttacaaagacgagaaggggaacctgaaggaggaggtagtaacgttctggaccgtggtggagcgtaagcggaccggccaaagcgcctatcagctaccgttcgacgggaaggagatcgtcaccacactccacatcaacgacatgttcctgctgggcctcaatgaggaagaaatcaactgggagaaccccgactacgaggtgctgaaggagcacctgtaccgcgtgcagaagttcacctccggggactactacttccggatcgcgaaaacctcctccatccagaacgccatcgagaagcagcagatcaacagcttcggcttcggcaaaaacgggtggagcacacacaaccccatcaaggtcaagatctccgtgtcaggcaagatctccaaggtgtga

SEQ ID NO: 7439 - RNA, 3372 nt, synthetic construct; identical to SEQ ID NO: 1639
  misc_feature 1..3372: note = Cas9 variant
  source 1..3372: mol_type = other RNA

SEQ ID NO: 7440 - RNA, 3378 nt, synthetic construct
  misc_feature 1..3378: note = Cas9 variant
  source 1..3378: mol_type = other RNA
atgaatggcctagttctaggcctagacatcggcatagcctcagtcggcgtcggaatcttgaacaaagaaacaggcgaaatcatccacgtcaactcacggatattcccagccgccaccgctgactcaaacgttgaacggcgaggcttcagacaaggacgcagactaggccgacgcaaaaagcaccgctccgcccgactgaacgacctattcgaagagttcgggtttataaccgacttctccgcagtgccgctgaacctcaacccgtacgccctcagagtcaaaggcctctccgaagaactaaccaacgaagaactcttcatcgcactaaagaacataattaaacgcagaggaatctcctacctagacgacgccagcgaagacggcgaaaccgcatcaaacgaatacggaaaagccgtcgaggaaaaccggaaattactcgcagacaaaacgcccggacaaatccagctcgaacggtttgaaaaatatggacaggtacgcggggacttcacggtcgtagagaacggggagaaccaccgcctcatcaatgtattttcgacctcagcctataagaaagaagcggagcgtatcctccgcagacagcaggagttcaacgtccgcatatccgacgagttcatcgaagcctacctcacgatcctcacaggcaaacgcaaatactaccatggaccggggaacgaaaaatcacgcaccgactacggacggttcagaaccgacggtacgacgctcgacaacatcttcgggatactcatcggcaaatgcacattctaccccgacgaataccgcgctgccaaggcttcctacacagcccaggaatttaacctgttaaacgacttaaacaaccttacagtacccacggaaaccaaaaagctcagaccagaacagaaaagacaaatcgtcgaatacgccagaacagcaaaaaccttagggaccccaacattactcaagtacatcgccaagctcgtcgacgggtccatcgacgacatcaaaggataccgcatagacaaatcagacaaacccgaaatgcacaccttcgatgcttaccgaaaaatgcgaaccctcgagctagtcgacgtcgacatcctaagccgcgaaaccctcgacgacctagcctacatcctaaccctaaacaccgaatccgaaggcatactagaagccctaaactcaaaaatgccaggaacattcaccaaagagcaaatcgacgaactgatccaattccgtaagaaaaactccgccgtgttcgggaaagggtggcacaacttcagcctgaaactgatgaacgaactaatacccgaactatacgaaacgtcagaagaacaaatgacgattctcacccgcctgggaaaacaacgctcccgcgaaatcagcaaaagaaccaaatatatagatgaaaaagaactgactgacgagatctacaatcccgtggtagccaaatccgtcaggcaagcaatcaaaataataaacctggcaacaaagaagtacggaatattcgacaacatcgtaatcgaaatggcccgggaaagcaacgaggacgatgagaaaaaggccatccagaacgtccaaaaggcgaacgaagatgagaaaaaggccgctatggaaaaagccgcagacctctacaacggaaagaaagaacttcccgattcgatattccacgggcacaaagaactcgcgacaaaaatacgcctatggcatcaacaaggagaacggtgcctctacaccggcaaaaacatcagcatccacgacctaatacacaacccccatcaatacgaaatagaccacatcctacccctctccctctccttcgacgatgggctagcgaacaaagtcctagtgctcgccaccgcgaaccaagaaaaaggtcaacgcacccccttccaagcactggactccatggacgatgcctggagttacatcgagttcaaacaatacgttagaaactcaaagagcctctcgaacaaaaagaaagactacctactaacggaagaagacatctctaaaatagaagtcaaacaaaaattcatcgaacgcaatctagtcgacacacgatattcgtcacgagtcgtactcaacaccttgcaagagttctacaaaaccaacgacttcgacaccaaaatctcagtcgtacgaggccaattcacttcccaattacgcaggaagtggaaaatagaaaaatcccgagacacataccaccaccacgccgtcgatgccctcataatcgccgcaagctctcaactacgactctggaagaaacaaaacaaccccctcatcagctacagagaaggccagctagtcgatccggagacaggagaaatactgtcgctaacggacgacgaatataaagaactcgtcctcaggcccccgtatgactatttcgtcgatacgctcaaaagcaagagcttcgaagactccatcctcttcagctaccaagtcgactccaaatacaaccgaaaaatatccgacgcgacaatttacggcacccgcaaagcacaactgggcaaagacaaacaagaggaaacctacgtattaggaaaaataaaagacatctatagccaaaaagggtacgaagatttcatcaaacggtacaaaaaggacacaacacagttcctaatgtaccacaaagacccccaaaccttcgccaaagtaatagaagaaatactaaaaacctacccagacaaagaactaaacgaaaaaggcaaagagatcccgtgcaacccatttgagaagtatcggcaagaaaatggacccatacggaaatacagcaagaaaggcaaaggccccgagattaaatctctcaaatactacgacaacaaactaggaaaccacatagacataaccccggtgaacagccaaaaccaagtcgtactacagtccctaaaaccctggcgcaccgacgtatacttcaacccccaaacaagtaaatacgaactaatgggactcaaatactctgaccttcggttcgaaaaagggtccggaagctacggcatctcacccgaaaaatacaacaaggttaaagccaaagagggggttgacgaggactccgagttcaaattcactctatacaaaaacgacctaatccttattaaggacactgaaacaggggaacaacaactcttccgctacggctcccgtaacgacaccagcaaacactacgttgaactaaagccgtacgagaaagcaaagttcgaaggcaaccagcaactcatgaatctcctaggaacagtggcaaagggcgggcaatgcctgaaagggatcaataagccaaacctctccatctacaaagtaaaaactgacgtccttggaaacaaatacttcatcaagaaagagggagaccaaccccagctcaacttcaaaaagaaaatatga

SEQ ID NO: 7441 - RNA, 3378 nt, synthetic construct
  misc_feature 1..3378: note = Cas9 variant
  source 1..3378: mol_type = other RNA
atgacaagcaagcaagagaacctgggcgcactcaccttcgggctagatatcggaatagccagtgtaggctgggcagtactaggtgaaaatcgcataatcgacctgggcgtccgttgctttgacaaagcagaaacggcgaaagaaggcgagagtctcaacctagcccgccggatggccagactgttgcgccggagactccgacggcgagcatggaggctaacaaaactggccaggctcctaaaacgggaaggcttaatagccgacgccaacctcttcaaaaacaaaatagagaaaaacacacccgtcccgaaaagcagctggcaactccgagtcgacgccttagacagaaagctaaacgctgaagaatgggcacgcgtgatataccacctctgcaaacacagaggcttccactggattagcagggcagaagagaaggccgccgagagcgattcaaaaggggaatccgggaaagtaaaacagggcctggccggaacaaagaaactaatgcaagaaaagaactatcgcaccgccgccgaaatggtactagccgagttcccagaagcgcaacggaataaacaaggagactacagcaaagccctaagcaggatccttctaggagacgagctaaaaacgctatttgagcaccagcgcaaactcgactccccattcgcaaccgaaaagctcgaagccgcaatactagggaacggagaccgaaagtctggactgttctgggcccaaaacccagcactggccggcagtgacctgctaaaaatgctgggatactgcacgttcgagaagaccgaataccgagccccaaaagcgtcgttcaccgcagagagacacgtgtggctcacacgactaaacaacctccgcatcgtagtagacggaacaacccgaccactcaacgaggcagaaaggcgcatagcactgctcatgccataccaacaagcaggggacttcacgtacaagcaactgagaaccgcactaaccaaggccgggttcctaccagaaagtttcaggtacacaggactgagctacgcaagcgggcaaaaagccggcgagaaaacaaaagaccctgaatccgctgccctagtcaagttcccagcatggcaagaactgagaaaaaccctagagaaaaaggaactcgccagcgagtggcagaaaatctcgacagacgccctggacggaaagccccaactcctagaccaaatcgcatgggtcctcagcgtctacaaagacgacgatgaggtaaaagcagaactaagcaagctcaacctcccgaacgcagagaaaatgatcgacgccctgctcgacataaggtttgacaaattctcaaacctaagcctaaaagccctctgcaaaatagtacccctgatggaacaaggacaacgctacgacgaagcgatagcgaacataccagaatacggtcaccactcacaactccataaagttggcgcgggcgaacacaaataccttccgcctttctacaaagaacgcgacaagaccggaaggatggtattcaacgacgacatggacataccaagaaaccccgtcgtcctgagggcacttaaccaggcgcgaaaagtcgtaaacgcgttaataaagaaatatgacagtccacacgaagtccacatcgaaatggcacgcgacctaagccgccccttagacgaacgccgagaagtcgagaaactgcaaaaggagttcagggacaacaacgaaaaaggcaaagcacaattcgcccaggacttcaacattgtcggcgcagtcaaagggaaggagttcgaaaagtatcaattatatagagaacaacagggcaaatgcgcctacagcatagagccaatggacattcacagattattcgagcagggatacgtggaaatagaccacgcgctcccgtacagcagatcgttcgacgacagcaaaaacaaccgtgtcctagtactggcaaaggaaaaccgagacaagggaaaccgcacacccttcgagtacctcggaggcaaggacaacagcgaaccgtggcggcagttcgtagcctttgtagaaggcaataaagcctatcgcctagctaaacggagccgactgcttaggaaagacttcggggacaaagaagcaaaggagttccgagaaaggaacttaaacgacacaaggtacatatgcaaattcttcaaaaactacgtcgaacaatacctccaactgcacgaagactcggaagcaaagcgatgcgtagtcctaagcggtcagatgacctcattccttagagcaagatggggtttagtaaaagtccgaggcgacagcgacaggcaccacgcactggatgccgccgtggtcgccgcatgttcacacggtatggtaaagaggctcagcgattactcgagaaggaaagagctggaacaagttagagaaggattcgtggacgtcgatacaggtgaaatcgtcaacccggcaatgttccagcaggtccaggaacatttccccaatccctggccacacttccgagatgaagtaaagctacgactcagcatggacgaccccgcactactgcgaagcgaaatggaaaaattcggcacatacacacccgaggccttacaggcactgcacccactattcgtgtccagggccccacagcgccgcaacagcggcgcagcacataaagacactatctatgcccaaccaaagcggctagtagcccaagggggtgtaacacagaaagtagccctaacatccctcaccctgaaggacctcgataaactgatcgatccacatcgaaacgacaaactgtacacagccatccgagcaaggctagaacaacacggcggaaagggcgacaaagccttcccctccagcaacccactacgcaaacccgacagcgaaggaaaccccacggggccaatcgtaagaggagtaacaatggtaatcgacaaactatccgggatcccaatccgcgggggcatagcgaaaaacgactcaatggtccgcgtagacgtattcacgaaggccaacaaattccacctggtgcctgtctatgtgcaccacacggtcgcaaaggcactcccaaaccgagccgtagtcgccttcaaagatgaggacgagtggacgctcatcgacgactcgttcgatttctgcttcagcctccacccgaacgacctagtccaagtacaacaaaagggaaaagcaggaatgataggctattacagcagctgccacagaggaaccggaaacataaacctctgggcgcacgaccgaaacctccaagtcggaaaagacggaatgatagagggaataggagtgaaaacagccctatcgctagaaaaattcaacgtcgacgtattagggaaccggtaccctgcaccgcccgagaaaagaagagacctcgcctga

SEQ ID NO: 7442 - RNA, 3378 nt, synthetic construct; identical to SEQ ID NO: 1642
  misc_feature 1..3378: note = Cas9 variant
  source 1..3378: mol_type = other RNA

SEQ ID NO: 7443 - RNA, 3381 nt, synthetic construct
  misc_feature 1..3381: note = Cas9 variant
  source 1..3381: mol_type = other RNA
atgaacggcctggtgctcgggctggacatcggcatcgccagcgtcggggtgggcatcctgaacaaggagaccggggagatcatccacgccaactccagaatcttccccgcggccacggccgacagcaacgtggagcggcgcggctttcggcaaggccgccggctcgggcgccggaagaagcaccgctcagcccggctgaacaacctgttcgaggagttcggcttcatcacggacttcagcgccatcccgctcaacctgaacccgtatgcgctgagggtcaaggggctctctgaggagttaaccaatgaggaactcttcatcgccctcaagaacatcatcaagcggcgcggcatcagctatctggacgacgcctccgaggacggggagaccgccagcaacgagtacggcaaggcggtggaggagaacaggaagctgctcgccgacaagaccccggggcagatccagttagagcgcttcgagaagtacgggcaggttcggggcgacttcacggtcgtggagaacggggagaatcaccgcctgatcaacgtgttctccaccagcgcctacaaaaaggaggctgaacggatcctccgccggcagcaggagttcaacgtccggatctccgacgagttcatcgaggcttacctgaccatcttgaccggtaagcggaagtactaccacggccccgggaacgagaagtcccgcactgactacggccgattccggaccgacgggaccacgctagacaacatcttcggcattctgatcgggaaatgtacgttctatccggacgagtaccgcgcggccaaggccagctacaccgcacaggagttcaacctgttgaacgatctgaacaatctgaccgtgcccaccgaaacgaagaagctcagccccgagcagaagcggcagatcgtggaatacgcccgcaccgcgaagaccctgggcacccctacactactcaaatacatcgccaagctagtcgacggctccatcgatgacatcaaggggtatcggatcgataagagcgataagccggagatgatgcacaccttcgacgcctatcggaaaatgcgcacactcgacctcgttaatatcgatgccctgtcccgcgaaaccctagacgacttagcccacatcctgacgcttaacaccgagagcgagggaatcttagaggcgctgaactccaaaatgcccagcaccttcacaaaggaacagattgacgagctgatccaattccggaagaagaatagtgccgtgttcggtaaggggtggcacaacttctccctgaagctgatgaacgagctgatcagcgagctctacgagacgtccgaggagcagatgaccatcctgaccaggctggggaagcagcggagccgcgagatctccaagcggactaagtatatcgacgagaaggagctcacggaggagatatacaaccccgtcgtggccaaaagtgtacgtcaggccatcaagatcatcaacgaggccaccaaacggtacggaatcttcgacaacattgtcatcgagatggcccgcgaaaacaacgaggaggacgccaaaaaggattacatcaagaggcagaaggcgaaccaggacgagaagaacgcctccatggagaaggcggcattccaatataacggcaagaaagagctgcccgacagcatcttccacgggcacaaagagctggccacaaagatacgcctgtggcaccagcagggcgagcggtgcctctacaccgggaagaacatctcaatccgcgacctgatccacaacccgcaccagtacgagatcgaccacatcctgcccctgagcctgtccttcgacgacggcctggctaacaaggttctcgtcctggccactgcgaaccaagagaagggtcagcgcacacccttccaagccatcgacagcatggatgacgcctggtcctaccgcgagttcaagcagtacgtccgcaacagcaagtcccttagcaacaagaagaaggactacctcctgaccgaggaggatatctccaagatcgaggtgaagcagaagttcatcgagcggaacctggtcgacacccgctacagcagtcgggtcgtgctcaacaccctgcaggagttctacaagacgaacgacttcgacaccaagatcagcgtcgtgcgcggacagttcaccagccagctgaggcgcaagtggaagatcgagaagtcccgagacacctaccaccaccacgccgtcgacgccctcatcatcgcggccagctcccagctgcgcctgtggaagaagcagaacaatcccctcatcagctacaaggaaggccagttcgtcgacccggagacgggggagatcctgtccctgacagacgacgagtacaaggagcttgtcttccggccgccctacgactacttcgtggacaccctcaagagcaagtctttcgaggacagcattctgttctcctaccaggtcgacagcaagtacaaccgcaagatttccgatgccaccatttacggcacgagaaaggcccagctcgggaaggacaagcaggaggaaacatacgtcttaggcaaaataaaggacatctacagccagaagggctacgaggacttcatcaaacgatacaacaaggacgagacccagttcctgatctaccacaaggatccccaaaccttcgaaaaggtgatcgaggagatcctcaagacgtaccccgacaaggagctgaacgagaaggggaaggagatcccctgcaaccccttcgagaaataccggcaggagaacggccctatcagaaagtactccaagaaggggaagggccctgagatcaagatcctgaagtactacgacaacaagctcgggaaccacatcgacatcactcccgtcaacagccagaaccaggtggtgctgcaatccttaaagccctggcggaccgacgtatactttaacccccgcaccagcaaatacgagctcatgggtctgaagtactccgacctgcggttcgagaagggcagcgggagctacggcatctccccggagaagtacaacaaagtgaaggccaaggagggcgtgaacgaggactctgagttcaagttcacgctctacaagaacgacctgatcctgatcaaggacaccgaaaccggcgagcagcagctgtttcgctacgggtcccggaacgacaccagcaagcactacgtggagctgaagccctacgagaaagcgaagttcgaggggaatcaacagcttatgaacttactgggcactgtggccaagggcggtcagtgcctgaaggggatcaacaagcccaacctctccatctacaaggtgaagaccgacgtcctgggcaacaagtacttcatcaagaaggagggggaccagccgcagctgaacttcaagaagaaattttga

SEQ ID NO: 7444 - RNA, 3381 nt, synthetic construct
  misc_feature 1..3381: note = Cas9 variant
  source 1..3381: mol_type = other RNA
atggcaagcaaacacgaaaacctcggcgcgctcacattcggcctcgacatcggaatagcaagcgtgggatgggcagtactaggcgaaaaccgcataatcgaccttggagtacgctgcttcgacaaggccgaaacagcaaaggagggcgagagcctaaaccttgcgaggagaaccgcaaggctgctaagacggagattgcggagacgcgcctggcgactcaccaagctggcacgactacttaaaagggaaggcctcatcgcggacacaaacgtcttccaaaagccgttcaaccttaaagacgcaaacgaaaagggcctgtcattctggcaactgcgagtggacgcgttagaccgaaaactctccgccgaggaatgggcccgagtcatataccacctatgtaaacatcgaggattccactggatatcgcgggcggaagaaaaagcagcagaaggagacagtaaatcggaaggtgggaaagtgaaacaaggcctagcaggcaccaagaaactaatgcaagagaaaaactaccgcacagcggccgaaatggtcctcacagagttccccgaagcacagaggaacaaacaaggggactactccaaggccctcagcagaatcctactcggcgacgaaatgacccaactcttcaagcaccagagggaattaggaaacccccatgcaacagaaaaactagaagcagcgatactaggaaacggcgaccacaaatcgggattattctgggcccagaaccccgctctagcgggaaatgacctactaaaaatgctggggcactgcacctttgaaaaagcagaataccgcgtcccgaaagccagtttcacagcagagagacatgtgtggctgacccgcctgaacaacctaagaatcgtggtagacgggacaacacggccgctaaacgaagccgaaagacacctggcactacttatgccctaccaacaagccggagacctaacatacaaacagctacgcaccgccctaactaaagcaggatacctccccgaatccttccgatatacaggcctagcttacgcatcgggacaaaaggcagatgaaaaggcgaaagaccccgaatcagctccattagtaaaactaccagcatggcacgaacttaggaaaacgctcgagaagaaagagctggcctcagaatggcagaaaatctcatccgacgccctcgacgggaaaccccaacttctagaccaaatcgcatgggtactgagcgtatacaaggacgacacagaagtggaggccgaactctgcaaactcaacttgcccaacgcggagaagatgatcgacgcactcctcgacatccgcttcgacaaattctcaaacctctccctaaaagccctccgacaaatcgtacccctaatggagcaaggccaacggtacgacgaggcagtcgcaaacatacctgaatacggccaccactcccaactccacgaagtgggagccggcgagcacaaatacctcccaccgttttacaaggagcgcgacaaaacgggccgaatggtgttcaacgacgacatggacattcccagaaacccagtcgtcctcagagcactaaaccaggcacgcaaggtagtgaacgccctcatcaaagaatacggaagcccgcacgaggtccatatagagatggcacgagacctatcccggccgctcgacgagcgacgcgatgtcgagaaactgcaaaaagagttccgcgaccgcaatgaaaaggacaaagcactattcgcacaggatttcaatatagtaggagcggttaaaggcaaagagttcgaaaaataccaactgtaccgtgaacagcaaggtaaatgcgcgtacagtatcgaacccatggacatccacagactatttgaacaagggtacgtagagatagaccacgcgctaccctactcccggagcttcgacgacagcaaaaacaaccgagtgctagtattggccaaagaaaaccgcgacaaaggcaacagaaccccgttcgagtatctcggcggcaaagacaactccgagcgttggcgacaatttgtcgcctttgtggaagggaacaaatcgtaccggctcgcaaaaagaagccgactactacgcaaagacttcggcaaagacgaagccaagggcttccgagaacggaacctgaatgatacccgctacatctgcagattctttaaaaactacgtcgaacaatacttacaattacatgaagactcggacgcgaaacggtgcgtcgtcctctcaggccagatgacatcattcctccgcgcacgatggggcctagtaaaagtacggggcgacagcgaccgtcaccacgccctcgacggagcgatcgtggctgcctgctcacactcaatggtcaaacgcctctcggactacagcagacgcaaggaactcgaacaggtccgagctggattcgtggacgtagacaccggggaaatcgtaaaccctgcaatgtttcagcaggtacaagagcacttccccaacccctggccccacttccgagacgaagtcaaactcaggctcaacgtcgatgaccctgcgctactgcactcagaaatgaacaggttcggaacctattccccagaggcgctgaaggcgctcagaccactcttcatctccagagccccacaaagacggaacagcggagcggcacacaaagatacaatatacgcccaaccagagagactcgtcgcacaagggggagtcacccagaaggtccccctaacaagtctcacgctgaaagacctggacaagctaatagacccccaccgaaacgagaaactctactcagccatccgaataaggctggaacaacacggcggaaaaggcgacaaggcattcccagcttcaaacccattaagaaaaccagactccgaaggcaacccaacaggccccatcgttagaggtgtaaccatggtcatagacaagctatccggcatcccgattcgcggagggatagcaaagaacgactcgatggtcagggtcgacgtcttcaccaaggcagggaaattccacctggtacccgtatacgtccatcacgcggtagcaaaagtgctacccaaccgcgcagtagtcgcttacaaagacgaaacagaatggaccctcatcgacgacggattcgatttctgtttctcaatgtaccccaacgacctactgcgcatcaaactgcgaaacgcatcccatctggggtactatgctagctgcaaccgatcaacgggtgcaataaatctctggagccacgaccgcaaccaacaagtcggaaaagacggcatgatcgaaagtatcggcgtcaaaaccgccctaaacgtagaaaaactcaacatcgacgtcctaggaaatagatacccagcaccaccagagaaaaggcgagacctggcatga

SEQ ID NO: 7445 - RNA, 3384 nt, synthetic construct
  misc_feature 1..3384: note = Cas9 variant
  source 1..3384: mol_type = other RNA
atgagcgacctggtgctcggcctggacatcgggatcggctccgtaggtgtgggcatcctgaacaaggtgacaggagagattatccacaagaacagccgcatcttccccgccgcccaggcggagaacaacgtcgagcggcgcatcaaccggcaaggccgccggctcacccgccggaagaagcaccgccgggtgagactcaaccacctgttcgaggagtccggcctcatcacggactttaccaacgtgagcatcaacctgaacccctaccagctgcgtgtcaaggggctcaccgacgagctgtccaacgaggagctgttcatcgccctcaagaatatggtaaagcaccgcggcatcagctacctggacgacgcctccgacgacgggaacagctccgtgggggactatgcccagatcgtcaaggagaacagcaagcagctggagaccaagacgcccgggcagatccaactagagcggtatcaaaagtacggacagctccgcggcgatttcaccgtggaggaggacgggaagaaacaccgcctgatcaacgtgttccccacctccgcctaccgagcggaggccctccggatcctgcagacccagcaggagttcaacccccagatcacggacgagttcattaacagctacctgcagattctaaccggcaagcgcaagtactaccacgggccgggtaacgagaagtcccggaccgactacggccgctacaccacgaagaaggacagcgaggacgagtacatcaccctggacaacatcttcgggatcctgataggcaagtgcaccttctaccccgaggaataccgggccgccaaggcgtcctacaccgcccaggagttcaacctcctgaacgacctgaacaacttgactgtcccgaccgagacaaagaagctgagcgaggaacagaagaaccagatcattaccaacgtgaagaacgagaaggccatggggcccgccaagctgttcaagtacatcgccaaactcctgagttgtgacgtggcggacatcaagggctaccgcatcgacaagagcgacaaggccgagatccacacgttcgaggcctaccgtaagatgaagaccctggccacaatcgacatcgagcaaatggagcgggagaacctcgacaagctggcctacgtcctgaccctcaatacggagaaggaggggatacaggaggcgctggagcacgagttcgctgacggcaccttctcccaggagcagatcgacgagttagtgcagttccgcaaggccaacagcagcattttcggcaaggggtggcactccttcagcgttaagctcatgatggagctgatcccggagctgtacgcaacctccgaggagcagatgaccatcctcacgcggctgggcaagcagaagacaaccagctccagcaacaagaccaagtacatcgacgagaagcagctgacggaggagatatacaaccccgtcgccgcgaaatcggtgcgccaggccatcaagatcgtgaacgccgccatcaaggagtacggggacttcgacaacatcgtcatcgagatggcccgggagaccaacgaggacgatgaaaagaaggcgatccagaagatccagaaggccaacaaggacgaaaaggacgccgccatgctcaaagcggcaaaccagtacaacggtaaggccgagctgccccacagcgtgttccacgggcacaagcagttagccaccaaaatccgcctctggcaccagcagggcgagcggtgcctgtataccggcaagacgatctccatccacgacctgatcaacaactcaaatcagttcgagatcgaccatatcctgcccctctccatcaccttcgacgacagcctggccaataaggtgttggtctacgcgacagccaaccaggagaaggggcagcgcaccccgtaccaggcactcgactccatggacgacgcctggagcttccgggagttaaaggccttcgtccgcgactccaaggcgctgagcaacaagaagaaagaatacctcctgaccgaggaggacatttccaagttcgatgtccggaagaagttcatcgagcgcaacctggtggacacgcggtatgccagccgcgtggtcctcaacgccctccaggagcacttccgggtgcacaagaccgacactaaggtgtccgtcgtgcgaggccagttcaccagccagctgcggagacactgggggatcgagaagacgcgggacacctaccaccaccacgccgtggacgccctcatcattgcggccagctcccagctaaacctgtggaagaagcagaagaacaccctcgtcagctactccgaggaccaactgctggacatcgagaccggcgaactcatcagcgacgacgagtacaaggagtccgtgttcaaggccccctaccagcacttcgtggacacgttaaagagcaaggagttcgaggactccatcctgttcagctaccaggtcgattccaagttcaaccgcaaaatcagcgacgccaccatctacgcgacccgccaggccaaggtggggaaagacaagaaggacgagacctatgtgctcggcaagatcaaggacatctactcccagacgggctacgacgcctttatcaagatctacaagaaggacaagtctaagttcttgatgtatcggcacgacccccagaccttcgagaaggtcatcgagcctatcctggagaactacccgaacaaggagctcaacgagaaggggaaggaggtgccctgcaaccccttcctgaagtacaaggaagaccacggctacatccgcaagtactccaagaaggggaacggccccgagatcaagagcctgaagtactacgactccaagctcggcaatcacatcgacatcaccccaaagaatagtaacaacaaggtagtcctgcagagcgtgtctccctggcgggccgacgtgtatttcaacaagaccacggggaaatacgagatcctgggcctcaagtacgccgacctgaagttcgagaaggggacaggcacctacaagatcagcgaggagaagtacaacgacatcaagatcaaggagggggtcgactcagatagcgagttcaagttcaccctgtacaagaacgacctcctgctgatcaaggacacggagaccaaggagcagcagctattccgctttctgtcccgaaccatgcccaacgttaaacactacgtggagctgaagccgtacgacaagcagaaattcgatgacaacgaggagctcatcaagatcctgggcatcgtcgcgaaaggagggcagtgcaagaagggcgtgagcaagccgaacatctccatctacaaaatccgcaccgatgtgctggggaaccagcacatcattaagaacgagggcgacaagcccaagctcgacttctga

SEQ ID NO: 7446 - RNA, 3384 nt, synthetic construct
  misc_feature 1..3384: note = Cas9 variant
  source 1..3384: mol_type = other RNA
atgaacggtctggtgctcgggttagacatcggtatcgccagcgttggggtgggcatcctggagaaggactccgggaagatcatccacgccaacagccgcatcttccccgcggccaccgcggacaacaacgtggagagacgcacctcccgccaggcccgccggctcaaccgcagaaagaagcaccgcagcgtccgtctgcacgacctgttcgaggagtacggcctactgacggacttctccaaggtgtccatcaacctgaacccgtaccagatccgcgtgcagggcctagacaaacggctgaccaacgaggagttgttcatcgccctcaagaacatcgtcaagcgccgggggatctcctacctggacgacgcgtcagaggacggcggggccgtttccagcgactacggcaaggccgtggaggagaaccgcaagctactcgcccaacagacccccgggcaaatccagctggaccggttcgagaagtacggccaagtccgcggcgacttcaccgtggtggaaaacggagagaagcggcgcctgatcaacgtcttctccacgagtgcgtaccggaaggaggccgagcggatcctccggaagcagcaggagttcaacaacaagattaccgagggtttcatcgaggactacctgaccatcttgaccgggaagcgcaagtattaccacggccccggcaacgaaaagagccgcacggactacggacgttacaccaccaagaaggactctcagggcgagtacatcaccctcgataacatctttgggatcctgatcggcaagtgcacgttctaccctgacgagtatcgcgcctccaaagccagctacaccgcccaggagttcaacctgttgaacgacctgaacaacctgaccgtgccgaccgagacgaagaagctctccgttgagcagaagaagacgatcgtcgagtacgcgaagaccgccaagaccctgggggccagtacgctgctcaagtacattgccaagctgatcggcgtgtccgtggaccagatccacggctaccggatcgaccccaatgaaaagcccgagatgcacaccttcgaggtctaccgcaagatgcagtctctggagacaatacgggtggaggagctcccccgcaaggtcatcgacgagctggcccacatcctaaccctcaacacggagcgggaagggatcgaggaggcgatcaatgccaagctgaaggacatcttcagccaggaccaggtcctggagctcgtgcagttcagaaagaacaatagcagcctgttctccaaaggttggcacaacttcagcctgaagctcatgatggagctcatcccagagctctacgagacctccgaggaacagatgaccattctcacccggcttgggaagcagaagtccaaggagacgagcaaacgcaccaagtacatcgacgagaaggagctgaccgaggagatctacaaccccgtggtcgccaagagcgtgcggcaagccatcaagatcatcaacgaggccaccaagcgctacggaatcttcgacaacatcgtcatcgagatggcgcgggagaacaacgaagaggacgccaagaaggagtacatcaagcgccagaaggccaacctcgacgagaagaacgccgcgatggagaaagccgccttccagtacaacgggaagaaggagctgccggataacgtgttccacgggcacaaggagcttgccacgaagatccggctgtggcaccaacaaggcgagaagtgcctctacaccggtaagaacatacccatctccgacctgattcagaaccgctacaagtacgagatagaccacatcctgccgctcagcctgtccttcgacgacagcctgtccaacaaggtgctcgtcctggccaccgcgaaccaggagaaaggccagcggacccccttccaggccctggacagcatggactacgcctggtcctacagagagttcaagtcatatgtgaaggactccaagctcctgagcaacaagaagaaggactacctgctcacggaggaggacatctccaagatcgaggtgaagcagaagtttatcgagaggaacctggtcgacacccgctacagcagccgcgtggtgctgaacgccctccaggacttctacaaggagcaccagttcgacaccaccatcagcgtcgtgcgggggcaattcaccagtcagctgcgccggaagtggggcatcgagaagtcccgcgagacgtaccatcaccacgccgtggacgcgctgatcattgccgccagcagtcagctccggctgtggaagaagcataacaaccccctgatcagctacaaggaggagcagttcgtagactccgagaccggggagatcattagtatgtccgacgacgagtacaaagagctcgtgttcaaggccccctacgaccacttcgtggacaccctcaagagcaagaagttcgaggacagtatcctattcagctaccaggtcgattccaagtacaaccgcaagatcagcgacgccaccatctacgcgacgcggaaggccaagctggacaaggacaagtccgaggagacctacgtgctgggcaagatcaaggacatctacagccaggccggatacgacaccttcatcaagatctacaacaaggacaagtcccgcttcctgatgtaccacaaggacccgcagaccttcgagaaggtaatcgaggagatcctccggacgtaccccagcaaggagctgaacgagaagaacaaggaggtcccctgcaacccattcgagaagtaccgccaggagaacgggccgatccggaagtatagccgcaagggaaacgggcccgagatcaagtccctgaagtactacgacaacaagctgggcaaccacattgatatcacccctaacgagagcatgaaccaggtcgtgctgcagtccctgaagccctggagaacagacgttttcttcaaccaccagaccgagaagtacgagctcatgggcctgaagtacagcgacctgaacttcgagaaggggtccgggaagtactcgataagtctcgagaagtacaacagcatcaagatgaatgagggggtgtccgaggagagcgagttcaagttcacgctgtacaagaacgacttgatcctcatcaaggacgcgctgacaaaggaggcccaaatcttccgctacggctcccgaaacgacaccagcaagcactacgtggagctgaagccgtacgacatgtccaagttcgagggagacgagcgcctaattaaggtgctgggcaccgtggcgaagggcgggcggtgtatcaaggggctgaacaagaaggacatcagcatcttcaaggtgaagacggacgtcttagggaacaagcacttcatcaagaaggagggcgaggagcccaagctgaagttctga

SEQ ID NO: 7447 - RNA, 3387 nt, synthetic construct
  misc_feature 1..3387: note = Cas9 variant
  source 1..3387: mol_type = other RNA
atgaccaaactaggcaaaccatacggcatcggggtcgacatcggatccaacagcatcgggttcgctgccgtagacgaaaacagccatctcatccgactcaaaggcaaaacggtcatcggcgcccgactcttcgaagaaggcaaagccgcggcgaaacgcagggctggccgaaccaccagacgaagattatcacgcaaccgatggcgcctctcctttcttcgagacttcttcgaatcacacatcacaccaaccgaccccaacttcttcatgaggcagaagtactccgagatctcccccaaagacaaggcccgatataagtacgaaaaacgcctcttcaacgaccgcaccgacgctgagttctatcaacagtactcaacgatgtaccacctccggaaccggctaatgaccgacccatcacgagcagacgtccgcgaaatctacttcgccatacaccacatcctaaaatctcgcggccatttccttacacccggagacgccaaagacttcaacacaaatgacgtggccctggatgaaatattcccagccctacaagacgcctacgcccaagtctacccagaccttggtataacctttgacgaagataaagccaacgagtttaaaacgatactgctaaacgaaatcgcaaccagcatcgacacccagcgcgcactcgtaaaactcctcctagccgaggaagacgacaaagacatactcaaacaacaaaaacaagttttgacagaatttgccaaagccgtcgtcggacttaaaactaagctcaacctcgcactaggaaccgaggttgactcctcagaagccacagcatggaacttctcactaggacagctagacgacaaatgggccgggatcgagtcagcgatgacggatgagggcacagaaatcctggaccaaataagagacctataccgggccagacttctaaacggcatagttccaacaggaaagaccctctcacaagctaaagtcgatgactacacacaacaccacgaagatctgcaactcttcaaagcgtatctcaaacaactagaagacgacggtaccgcaaaagccatccggcaactctacgacagatacatcgacggcgacgatgcagcgcccttcctcagagaaaacttcgtcaaagccctaaccaaagacgtcaccgcgcacccaaacaccaagtccccagagctattagaaagactcgcacagcccgatttcatgctaaaacaaagaaacaaagcaaacggtgcaattcccgttcaaatgcaacaacgggagctcgaccaaatcatcaaaaaccaagcagtctactacgactggctagcggcaccaaacccggtcgagaagcacaggaagtccatgccctaccaactagacgagctcttgaacttccggataccctattatgtaggacccctagtgacagccaaagaacaaaaggccgcccaaggaggagtctttgcgtggatggtccgtaaagacccagaaggaaacataaccccatacaacttcgacgaaaaagtcgacagggaggcaagcgccaacaccttcattcaacgcatgaagacaactgacacgtacctaataggcgaggacgtcctccccaaacaatcgctgctataccagcgatacgaggtgctcaatgagctcaacaatgtacgagtaaacaacgagaagctatcaatcgaacaaaaacaacaagtaatccgcgaacttttcgagcgccacaattcagttacaataaaacaattcgcagaaaacctgcgcgcacacggagactatgcacacatcccggaaatcagaggtctagcagacgaaaaacgcttcctatcctccctatcgacctaccgacaacttaaatctctactgcccgaagcaatcgacgaccccgctaagcaagcagacatcgaaaacatcatagcgtggagcaccgtattcgaagacgcagccatcttcaagaccaaactgaaggagatctcatggctaggatcagaagccataaccaaactatcgaacattcgataccgtgggtggggccaattcagccgaaagtttctcaacggattaaccctgggcaacggacacaccatcatccaagaactcctgctcagtacaaacaacttgatgcagatactaaccgacgagacactccaaaagaaaatgaccgaattgaacgccgacaaactcaaaacagcgaacatcaacgacgcgatagacaacgcctatacctcaccaagcaacaagaaagccctcagacaagtactcagagtcgtagacgacatcaaacgcgccgcagacggccaagatccctcctggctctatgtcgaaacagccgacggcggagggaccccgggaaaacgcacgcgtgccaggcaacaccaactacaagaaatatacgccaacgccgcacacgaactgatagacaccgccgtaagaggcgaactagaagacaaaataagtgataaagccgactttaacgaccggctcgtcctatacttcatgcaaggaggcagagatatatacaccggcgccccgctaaacatcgaccaactatcctcatacgacatcgaccacatcctcccccaatcgctcatcaaagacaactcacttgacaaccgcgtcctagtacacgctataatcaaccgcgaaaagaacgccacattcgcctcgacaatatacgcccaaaagatgaacgctacttggaggcaatggcacgaggccggactgatctccggcagaaaactccgcaacctgcaaatgcgccctgaccaaatcgataaatatgcctctggctttgtcgcccgccagctagttgagacacgacaaataataaagctcaccgaacaaatagtcgccgctcaataccccgacacgaaaataatcgcagtcaaagccggcttaagccaccaacttagagaagaactcgaatttcccaaaaacagagacgtcaaccactaccaccacgccttcgacgccttcctagcagcgcgcataggtacatacctcctcaaacgcttcccaaacctccaagccttcttcacatacgggaaattcaccaaagccgatgtgaagaaactcagagggttcaatttcatcagggatataacccacgcagaagacaaaatcgtcgccaaagatacaggagaagtggtctgggacaaacaaagggacgtagacgaactagaccgcatctacaacttcaaaagaatgctcatcacccacgaggtaagattcgaaacagccgacctgttcaaacaaaccgtgtatggtgcccgcgactccaaagaagccggcggatcgaaacaacttatccccaagaagaaagacatccaattgatcttcatgggcgcaatttccgagcgcacacgaccgattctgcccctgtga

SEQ ID NO: 7448 - RNA, 3387 nt, synthetic construct
  misc_feature 1..3387: note = Cas9 variant
  source 1..3387: mol_type = other RNA
atggacgagaaaatggactatcgaatcggcctcgacataggaatcgcgagcgtaggctgggcagtactacaaaacaacagcgacgacgagcccgtccgaatagtggacctcggggtaagaatattcgacacagcagagataccaaagacaggagaatccctcgcaggtccgaggcgcgccgcacgaactacgagacgccgactacgcaggcgaaagcaccgactagaccgtataaaatggctattcgaaaatcaaggtctaataaatatcgacgacttcctaaagcggtataacatggcaggcctcccagacgtctaccaattgcgatacgaagcactcgatcggaagctcaccgacgaagaacttgcccaggtactactacacatagcgaaacacagaggctttcgctcaaccaggaaggccgaaacagccgccaaggaaaacggagccgtactaaaggcgacagatgagaaccaaaaacgcatgcaagaaaaaggatacagaaccgtaggcgaaatgatatacctcgacgaagcattcaggatcggctgctcatggagcgaaaagggatacatactcacgccccggaacaaagcagaaaactatcaacacacaatgctccgggcgatgctcgtcgaagaagtaaaagaaatcttcagcagtcagagacggctcgggaacaaaaaggccaccgaagaactagaagaaaaatatctagaaatcatgaccagccaacgatccttcgacctcggcccaggcatgcaaccagacgggaaaccatccccgtacgcaatggaaggctttagcgaccgggtaggaaaatgcaccttcctcggcgaccaaggagaactccgaggagcaaaaggcacctacacagcggaatacttcgtagccttacagaaaatcaaccacaccaagctcgttaaccaagacggcgaaacaagaaacttcacggaggaagaacggcgagccctcactctgctactgttcacacagaaagaagtcaagtacgcagccgtgagaaagaaactaggcctgcccgaagatatcctgttctacaacctaaattacaagaaagccgccacaaaagaagaacagcaaaaagagaaccagaacactgagaaagccaaattcatcggaatgccgtactatcacgattacaagaaatgcctggaggaacgggtcaaatacctaacggagaacgaagtcagggatctgttcgacgaaatcggaatgatcctaacatgctacaaaaacgacgactcacgtaccgaacgcctcgccaagctgggactggtcccaatcgagatggaggggttactagcatatacgccaaccaaattccaacacctgtccatgaaggccatgcgaaacataatcccgttcctcgagaaagggatgacgtacgacaaagcctgcgaagaagccggctatgacttcaaagcagactcaaaaggcacgaaacagaaactccttacgggtgaaaacgtcaaccagacgataaacgaaatcacgaacccagtcgtaaagcgctcggtaagccaaacagtcaaggtcatcaacgcgatcatacgaacatacggatctccacaagcaataaatatagagctcgcgcgagaaatgtcaaaaacattcgaggaacgacgcaagataaaaggagacatggaaaagagacagaaaaacaacgaggacgtcaaaaagcagatacaggaactaggcaaactcagtccaaccgggcaagacatactgaaataccggttatggcaagagcaacaaggcatctgcatgtactcaggtaaaacaatacccctcgaagaactcttcaaacccggctacgacatagaccacatactaccgtatagcataacgttcgacgacagcttccgcaacaaagtcctagtaacgagccaggaaaacaggcaaaaaggcaacagaacaccctacgagtacatgggaaacgacgaacaaagatggaacgagttcgaaactagggtgaaaactacgattcgggactacaagaaacaacaaaaactcctaaagaaacactttagcgaagaggaacggtcagaatttaaagaacgcaaccttaccgacacaaaatacatcaccacagtcatctataacatgataagacaaaacctagaaatggcaccactgaaccggcccgagaaaaagaaacaagtgcgagctgtcaacggagccataaccgcatacctacgcaaacggtggggactaccacaaaagaaccgggaaacggatacgcaccatgcgatggacgcagtagtgatagcgtgctgcacagacggcatgatccagaaaattagcaggtacacgaaagtcagggagcgatgctactctaagggcacagagttcgtcgacgctgaaacaggcgaaatcttccgcccggaagattacagccgggccgagtgggacgagatcttcggagtacacatacctaaaccgtgggagacattccgtgcagaactagacgtcaggatgggcgacgaccccaaagggttcctagatacacacagcgacgtcgcactcgagctagactacccggaatacatctacgaaaacctacgccctattttcgtcagccgcatgccgaaccataaagttaccggggcggcacacgcagataccatccggagcccgcgacacttcaaagacgagggaatagttctcaccaaaaccgccctaacggacctaaaactcgacaaagacggcgagatagatgggtactacaatcctcaaagcgatctactcctgtacgaagcactaaagaaacaactgctcctatacggcaacgatgctaagaaagcattcgcgcaagacttccataaacccaaagccgacggcaccgaaggaccagtagtacgcaaagtgaaaatacagaaaaagcaaaccatgggggtcttcgtcgacagtggtaacgggatagcggaaaacggcggcatggtgagaattgacgtgttcagggtcaacgggaaatactacttcgtacccgtatatacagcagatgtcgtaaagaaagtcttacccaaccgagcctccaccgccaacaaaccgtactcggaatggcggacgatggaagacaaagacttcctcttctcactatactcaagagatctggtacacataaaaagtaaaaagggaatccccatcaagaacgtagacggcagcctaggcgaatcaaaggaagtatatgcgtactacatcggcgccgacatcagcggagcaaaaatcgaaggcaaagcacacgacagtcggtacactttccgaggcatcggagtacaaaaactcgaactaatcgaaaaatgccaggtagacatcctcggccacatcagtaccgtgaaaaacgagaaacgaatgggcttctcctga

SEQ ID NO: 7449 - RNA, 3387 nt, synthetic construct
  misc_feature 1..3387: note = Cas9 variant
  source 1..3387: mol_type = other RNA
atgaacgacaaaaaccaaaaataccgccttggcctcgatctaggaaccaactccatcggatggtgcatctactccctcgacgtcaataacaaaccagaaactctcatcgacatgggtgtaaggatattcagcgacggcagagacccaaaaaccaaggaacccctcgccgtcgaacgccgcactgcccggggcctccgcagaatattacacagacggaaactccgcagaagacaaatgttccgactactccaagagcaagggcttatgcccaacgacgccagcgaagccgcggccctcaaatcactaaacccctacgaattacgagtaaaagcgctcgacacgaaactagaaccctacgaactgggccgagccctgttcaacctctcagtacgacgcgggttcaagtcgaaccgcaaagaggccgtccaagagaaagaaaaagactctcaaaatgacgccaagtcccaaaacgaaaaatgcgaacacctagccaaggccataaaagacagcgggtgccgtaccctaggcgagttcttgtggaaacacaagaacacagaaacacagcaaaccgaaaacgacgcacgcaacataggcatgcgatttgtaccaggcagatcgaactactacccgacaagaagaatgtacgttgaagagttcgatgcgattcgcaaggcccaagaaccctattacagcggcgtcaactgggacgccttacacgagaaactcttctaccaaaggccactaagagcacaggaacgcggaaagtgtagatacatgcccgacaaagaacgaactttcaaagccatgccctgctcccagaagatacgcatactgcaagaggtctacaacatggactacatcgatgaatacggcaagacaatcccgctagaagaagcccaaaccgactcactgatcagcctactagacaagagagaaaaactatccttcaaagccatgaagaaagaactaggcattgacgaaagctgcactttcaacctcgaacgcggaggtagggaatacctgcaaggcaacgccgccgcggtaaaactacgaaacaagaaacgattcggagagctctgggactccctctcgctggctaaacaggacgcaatagtcgaaaaactaataacggccgacgaagacgccgaaattatctccatgcttgcacagtacaacttgactgacgagcaaaagaaaaacatagcagtcacagtattaccatcaggaaccgcgatgctctgcaaagaagtaaccgagatgctagtccagaaaatggagcaaaataaaattccactcaccgtcgcagtgcaaatgctcggatacacatacgcagaccaaagcgtcagggaagaagatacactcccatattacggcgccattctcaccggatccaccatgggagcgcaccccgaagcagacgaatccgaacccgagttaaaatacgggaaaatttccaacccaaccgtccacgtagcgctaaaccaaacacgtacggtcgtgaatgccctgataaaggcttacgggaaaccgcaacaaatcgtcgtcgaactcagtcgcgaccttaaagcctcaagagaagccaaggctcgaatccagaaaactatcacaatgaatcagaaaaggaacgaaagagacaacaagaacatcaccgacatcaccaaaatcccctatcccaacagaaacgaccgactaaaatacagactatgggaagaactaggatcaggaagtaacagcttctcccggaaatgcctctactgcggcaaaccaatatctgggagcgagatcttcactgaaaacatagaaatagaacacatactacccttcgggaggactctcttcgacggggaaacaaacaagacagtagcacataccgactgcaaccgcgacaagggcgaccgctcaccattcgaagccttcggcagcagccccaacggctacaactggcacgaaatatgcgcccgggccaacagcctgaaaaacccggcaaaacgcacactattcgcagagaacgcaatggaaaagttcgaaaaagacaatagcttcatacaacgtcaactcaccgacaacgcatacctatcacggtcagcactgagataccttcgatgcatatgcaaagatgtgtggagcataaacggcggcatgactaaactattgcgagacaaatggaacatagacagcatactaaagagaaaaatcgacgaccccgaaatcgcccacttcgaactcaaaaacgaccaaatcggtcaatacaagaaaaaccgctacgaccaccgacaccacgccctcgacgccagcgtcatagccctcatcgacagagcaatggtccaagaaattagtcaactaaataaaatccgcctcaaaaaccgaatagaagcacctcaaatgccggtgctacgctcagaacttatcgaaaaggtcaaacacataaccgtcagtttcaaacccgatcatggcagacaaggcaaactgtcaaaagaaacgctactcggaaaaataaagaaaatagagaaagtagacattgactcaattcaaaccgacgacattgcatcgataaaggacgacgcaatacgtacacgcttcgaaacaaaaagacgagaactaggagacataaccaaagccaaggccgcactcaaaaccgagttcccgaaactggacgtcttcaagacctactatgtatccagaacacccatcgtatcactcacagaaaagaatattaatagcatcgtagacgagaagatcaaagaaaaactaaaaacgttcataaaagaacacgccgacctatcattcgcggaacaactgcaaaaattcagcgaaaccgaatggatagggaagccgtcagcagcaggcaaaccaggcaagaaataccggatagaaaaagtgcgctgtataaactgggggcaaacgcccataacaatcacctcgagcgctgtccccagatacctctgccccgaagactacctcgcagcggtagtctggcaaatcccaagcaaaaagaaagacaccgagcctgaatacaaagcgaccttcctacgcagagacgagttcgacgttaacaacaaacccaaaaagctcgaaaaaccacacgacgcggcccaatacatctgcatgctctacaaagacgactacctggagttcacagaatccggcgccacgcacctctgccgcatagcaggcctaccggccagccaaaataacaaaatagacatccgcccgatctatgcagtatccgactgcaaagactggatcatcgcaacaaacgaaaacatgctagaaccctgctggaaaccccaaaaagaagaaaagcgtatctccgtaaacgtcctcttcgggaaacataaagcccgatcggtcacagtaaacccaatcggacgcgtctttagaaagtga

SEQ ID NO: 7450 - RNA, 3387 nt, synthetic construct
  misc_feature 1..3387: note = Cas9 variant
  source 1..3387: mol_type = other RNA
atgagcgacctggtgctcggcctggacatcgggatcggctccgtcggggtgggcatcctgaataaagtgaccggggagatcatccacaagaacagccgcatcttccccgcggcccaggcggaaaacaacgtcgagcggcgcaccaatcggcagggccgccggctgacgcgtcggaagaagcaccgccgcgtgcgcctgaaccacctgttcgaggagtccggtctcatcaccgacttcaccaaggtgagcatcaacctgaacccgtaccagctgcgggtcaaggggctcatcgacgagctgtccaacgaagaactattcatcgccctcaagaacatggtgaagcaccgcggtatcagctacctggacgacgcctcggacgacgggaacagctccgtgggcgactacgcccagatcgtcaaggagaactccaagcagctggagaccaagacgccagggcagatccagctagagcggtaccagaagtacggccaactgcgcggcgacttcaccgtggaggaggatgggaagaagcaccggctgatcaacgtgttccccacctccgcgtaccgatctgaggcgttgcggatactgcagacacagaaggagttcaacccccagataacggacgagttcatcaaccgctacttagagatcctcaccggcaagcggaaatactaccacgggccgggcaacgagaagtcccgcaccgactacggccggtacaccacgaagaaggacagcgagaacgaatacatcaccttggacaacattttcgggatactgatcggcaagtgcaccttctatcccgaggagtaccgcgccgcaaaggcctcctacaccgcgcaggagtttaacctcctaaacgacctgaacaacctcacggtccccaccgagaccaagaaactgagcgaggaacagaagaaccagatcatcaactacgtgaagaacgagaaggccatggggccggccaaactgttcaagtacatcgccaagctcctgtcctgcgacgtggccgacatcaagggctaccgcatcgacaagagcgacaaggcggagatccacaccttcgaggcataccggaagatgaagacgttagagaccatcgacttcgagaaaatgtcccgcgatcagctcgacaagctggcctacgtcctgaccctcaacaccgagcgggaggggatccaggaggccctggatcacgagttcgccgacggcaacttcagccaggagcagatcgacgagctggtgcagttccgcaaggcgaacagctccatcttcggtaaggggtggcacaacttcagcgtgaagctcatgatggagctcatcccggagctgtacgccacgtccgaggagcagatgaccatcttgacccggctgggcaagcagaagaccacgagctcctccaacaagaccaagtacattgacgaaaagctactcaccgaggagatctataaccccgtagtggccaagtccgtgcgccaggccataaagatagtcaacgccgcgatcaaggagtacggggacttcgacaacatcgtgatcgagatggcccgggaaaccaacgaggacgacgagaagaaggctatccagaagatccagaaggccaacaaggatgagaaggacgccgccatgctgaaggccgccaaccagtataacggccgcgccgagctgccccacagcgtgttccacgggcacaagcagctcgcgacgaagatccggctgtggcaccagcaaggcgagcgctgcctgtataccggcaagaccatctccatccacgacctgatcaacaaccccaatcagttcgagatcgaccacatcctcccgctgtcgatcaccttcgacgactccctggccaacaaggtcctcgtgtacgccacggcgaaccaggagaaagggcagcgtaccccttaccaggccctggacagcatggatgacgcgtggtccttccgcgagctgaaggccttcgtccgggagagcaagtccctcagcaacaagaagaaggagtaccttctgaccgaagaggacatctcccgcttcgacgtgcggaagaagttcatcgagcgcaacctcgtggacacccggtacgccagcagggtcgtcctgaatgccctgcaggagcacttccgggcccacaagaccgacacaaaagtgtccgtcgttcgcggccagttcaccagccagctccgccggcactgggggattgagaagacccgcgacacctaccaccaccatgcggtcgacgctctgatcatcgccgccagctcccagttgaatctctggaagaagcagaagaacacgctggtcaattacagcgagaaccagctgctcgacatcgaaaccggcgagctgatctccgacgacgagtacaaggagagcgtgttcaaggccccctaccagcacttcgtggacaccctcaagagcaaggagttcgaagacagcatcctgttctcctaccaggtcgacagcaagttcaaccggaagatctccgacgcgaccatctacgccacacgccaggccaaggtggggaaggacaagaaggacgagacctacgtgctgggcaagatcaaggacatctacagccagaccggttacgacgccttcatcaaaatctaccagaaggacaagtccaagttcttaatgtaccggcacgaccctcaaaccttcgagaaggtcatcgaaccgatcctcgagaactaccccaacaaagagatgaatgagaaggggaaggaggtgccttgcaaccccttcctgaagtacaaggaggaacacggcgactacatccgcaagtacagcaagaaggggaacggcccggagatcaagagtctgaagtactacgacagcaagctcggcaaccacatcgacatcacgcccaaggactccaacaacaaggtggtcctgcagagcgtgtcaccctggcgggcggacgtgtacttcaacaagaccaccgggaagtacgagatcctgggcctcaagtacgccgaccttcagttcgagaaggggacaggcacgtacaagatcagccaggagaagtacaacgtcatcaagaagaaggagggggtggacagcgactccgagttcaagttcaccctgtacaagaacgacctcctgctgatcaaggacaccgaaaccaaggagcagcagctgttccgcttcctcagccggacgaagcccaatgtgaagcactacgttgagctgaagccgtacgacaagcagaagttcgagggcaacgagtccctcatcaatgtgctgggcgccgtggccaagggcgggcagtgccagaaggggatcaacaagcccaacatcagcatctacaaggtccgtaccgacgtgctgggcaaccagcacatcatcaagaatgagggggacaagccaaagctcgacttctga

SEQ ID NO: 7451 - RNA, 3387 nt, synthetic construct
  misc_feature 1..3387: note = Cas9 variant
  source 1..3387: mol_type = other RNA
atggacgagaaaatggactaccgaatcggcctggatatcggcatagcaagtgttgggtgggccgttctacaaaataacagcgacgacgaacccgtgcgcatagtggacctcggcgtccggatattcgacaccgcagaaatccctaaaacaggcgaaagcctagccggcccgagacgagcagcacgaacaacccgccgacgactacgccgccgaaagcacaggctggaccgaatcaaatggctgttcgaaaatcaaggcttaatcaacatcgacgactttctcaagcggtacaacatggccggactacccgacgtgtatcagctgcgatacgaagcgctcgacagaaaactcacagacgaagaactagcccaggtcctcttacacatcgcaaaacaccgcggattccggagcacccggaaggcagaaaccgcagcgaaagagaacggagcggtcctaaaagcaaccgacgaaaaccagaagagaatgcaggagaaagggtatcgaactgtaggagaaatgatctacctcgacgaagccttccgaacagggtgcagctggagcgaaaagggatacattctgacaccaagaaacaaggcagagaactaccagcataccatgctcagggctatgctcgtggaagaagtaaaagagatatttagcagccagcgcaggctaggaaacgagaaagccacggaggagctcgaggagaaatatctcgaaataatgaccagccagcggagctttgacctaggacccggcatgcaaccagatggaaagcccagcccatacgcgatggaaggcttcagcgaccgcgtagggaaatgcaccttcctaggcgaccaaggcgaattacgaggggccaagggaacctacacagccgaatactttgttgcacttcagaaaataaaccacaccaagttggtcaaccaagatggcgagacgcgcaacttcacggaagaggaacgacgcgcactaacactactactatttacgcaaaaggaggtcaaatacgcagcagtacggaagaaactcgggctgccagaagatatactattctacaacctcaactacaagaaagcagcaacaaaagaagaacaacaaaaagaaaaccaaaacaccgaaaaggccaaattcatcggaatgccatactaccacgactacaaaaagtgcctcgaagaaagggtcaaatacctaaccgaaaacgaagtccgcgacctcttcgacgaaatcggcacaatactgacgtgttacaaaaacgacgactccagaacagaacgacttgccaaactaggattagtgcccatagaaatggagggcctactagcctacacccccacaaaattccaacacctaagcatgaaagcgatgagaaacatcatcccctttctggaaaagggcatgacgtacgacaaagcgtgcgaagaagccggatacgactttaaagccgacagcaagggcataaaacaaaagctgcttaccggagagaaagtcaaccaaaccataaacgaaatcactaacccagtagtaaaacgcagcgtaagccagaccgtaaaggttataaacgcgataataagaacatacggcagcccacaagcgataaacatcgagttagcacgcgagatgtcgaaaactttcgaagaacgacgcaaaatcaagggcgacatggagaaaagacagaaaaacaacgaagacgtgaagaaacaaatccaagaactaggcaaactaagcccaacaggtcaagacattctcaaataccgactatggcaagaacaacaaggaatctgcatgtacagcggaaaaacgatccccctggaggaactcttcaagccaggctacgacatcgaccacatcctaccctactcaatcaccttcgacgacagcttccgaaacaaggtgctggtaacaagccaagaaaaccgacaaaaagggaaccggaccccgtacgagtacatgggaaacgacgaacagcgatggaatgagttcgaaacacgagtgaagacaacaatcagagactacaaaaagcaacaaaaactcttaaagaagcacttctccgaggaagaacgctccgagttcaaagaacggaacctgaccgacacaaaatacataaccaccgtcatatacaacatgatccgtcaaaatctagaaatggcaccactcaaccgtcccgagaaaaagaaacaggtgcgagccgtcaacggagccatcacggcatacctacgaaaacgctgggggctcccgcagaaaaacagagaaacggacacccaccacgccatggacgcggttgtcatcgcatgctgcaccgatggaatgatacagaaaatcagccgctacaccaaagtcagagaacgatgctactcaaaaggtaccgaatttgtagatgcagaaacgggagaaatattcagaccggaagactattcccgagcagagtgggacgagatcttcggagtccacataccaaaaccctgggaaacgttccgagcggaactcgacgtacgcatgggagacgatccgaaaggcttcctggacacacacagcgacgtagcacttgaactagactacccggaatacatctacgaaaacctgcgtccgattttcgtcagtagaatgccaaaccacaaagtgacaggagcggcacacgcagataccatccggagcccccgacacttcaaagacgaggggatagtgctcacaaaaacagcactaacagacctcaaactagacaaagacggagaaatagacggctactacaacccccaaagcgacctcctactatacgaagcactgaagaaacaactcctcctctacgggaacgacgcgaagaaagccttcgcccaagatttccacaaacccaaagcggacgggacagaaggaccagtagtaagaaaagtaaaaatccaaaagaagcaaacaatgggagtcttcgtcgactccggtaacgggatcgcggaaaacggagggatggtacggatagacgtgttccacgtaaacgggaagtactatttcgtaccagtctacaccgcagacgtcgtaaagaaagtactacccaacagagctgccaccgcacataaaccatacggggaatggaaagtcatggaggacaaagatttcctattctccctctacagcagagacctcatccacatcaaaagcaagaaagacataccaataaaaatggtcaacggtggcatggaaggcatcaaagagacctacgcatattacataggagcagacatatcagcggccaacatacagggaatcgcccacgacagcaggtacaaattccgaggcctcggaatacaatccctggacgtgctagagaagtgtcaaatcgacgtactcgggcacgtcagcgtagtacgaagcgagaaacggatgggattctcctga

SEQ ID NO: 7452 - RNA, 3387 nt, synthetic construct
  misc_feature 1..3387: note = Cas9 variant
  source 1..3387: mol_type = other RNA
atgagcgacctggtgctcggcctggacatcgggatcggctccgtcggggtgggcatcctgaacaaagtgaccggggagatcgtccacaagaacgcccgcatcttccccgccgcgcaggccgagaacaacgtggagcggcgcaccaaccggcagggccgccggctcacgcgccggaagaaacaccgccgggtgcgcctgaaccacatcttcgaggagagcggcctgatcaccgatttcaccaaggtctccatcaacctcaacccgtaccagctgcgggtgaaggggctgaccgacgagctcagcaacgaggagctgttcatcgcgctgaagaacatggtgaagcaccgcggcatctcctacctcgacgacgccagcgacgatgggaactcctcggtcggcgactacgcccagatcgtgaaggagaactccaagcagctggagacgaagactcccgggcagatccagctggagcggtaccagaagtacggccagctcagaggtgacttcaccatcgaggaggacgggaagaagcaccggctgatcaacgtgttccccaccagcgcgtaccgtgccgaggccctgcggatcctccagacgcagcaggagtttaacccccagatcaccgacgagttcatcaactcctacctgcagatcctgaccggcaagcgcaagtactaccacgggccgggcaacgagaagtcccggaccgactacggccgctacacgaccaagaaggacagcgaggacgagtacatcaccctcgacaacatcttcgggatcctgatcggtaagtgcaccttctaccccgaggagtaccgggccgcgaaggccagctatacggcccaggagttcaacctgctcaacgacctgaacaacctgaccgtccccaccgagaccaagaagctctccgaggagcagaagaaccagataatcacgtacgtgaagaacgagaaggccatggggcccgccaagctgttcaagtacatcgcgaagctgctcgcctgcgacgtggccgacatcaagggctaccgcatagacaagtctgacaagccggagatccacaccttcgaggcctaccgcaagatgaagaccctggagaccatcgacgtcgagcagatggagcgggagaagctggacaagctcgcctacgtgctgacgctgaacaccgaacgcgaggggatccaggaggcgattgagcacgagttttccgacggcaccttcagccaggagcaggtcgacgagctcgtgcagttccggaagtccaacagcagcatcttcggcaaggggtggcacaacttctccgtgaagctgatgatggagctgatccccgagctctacgccaccagcgaggagcagatgacgatcctgacccgcctgggcaagcagaagcggacctccagctccaacaagaccaagtacatcgacgagaagcgcttaacggaggagatctacaaccccgttgtcgccaagagcgttcgccaggcaatcaagatcgtgaacgccgcgatcaaggagtacggggacttcgacaacatcgtcatcgagatggcccgcgagatgaacgaggacgacgagaagaaggccatcaagaagatccaggaggccaacaagtccgagaaggacgccgcgatgcggaaggccgccaaccagtacaacggcaaggccgagctgccccacagcgtgttccacgggcacaagcagctggcgaccaagatccgcctctggcaccagcagggcgagcggtgcctgtacaccggcaagaccatctccatccacgacctgatcaacaacccgaaccagttcgagatcgaccacatcctccccctgagcatcacgttcgacgactcccttgccaacaaggtcctggtctacgccacggccaaccaggagaaggggcagcgcaccccttaccaggccctggacagcatggacgacgcctggtccttccgggagctgaaggccttcgtgcgcgagagcaagaccctgtccaacaagaagaaggagtacctcctgaccgaggaggacatctcgaagttcgacgtccggaagaagttcatcgaacgcaacctggtggacacgcggtacgcctcccgcgtagtcctcaacgccctgcaggagcatttccgggcccgcaagatcgacaccaaggtgagcgtggtccgcggccagttcacctcccagctgcggcgccactgggggatcgacaagacccgggacacgtaccaccaccacgcggtggacgccctcatcatcgccgccagcagccagctgaacctgtggaagaagcagaagaacaccctggtgtcctacagcgaggaccagctgctggacatcgagaccggcgagctcatctccgacgacgagtacaaggagagcgtcttcaaggccccctaccagcacttcgtggacaccctgaagtccaaggagttcgaggacagcatcctgttctcctaccaggtggacagcaagttcaaccgcaagatctccgacgcgacgatatacgccacccggcaagccaaggtagggaaggacaagaaagacgagacctacgtgctcggcaaaatcaaggacatctacagccaggccggctacgacgcgttcattaagatctaccagaaggacaagtccaagttcctgatgtaccgccacgacccgcagaccttcgagaaggtgatcgagcccatcttagagaactaccccaacaaggagatgaacgagaaggggaaggaggtcccctgcaacccgttcctcaagtacaaggaggagcatggcgactacatccggaagtacagcaaaaaggggaacggccccgagatcaagtcactgaagtactacgacagcaagctgggcaaccacatcgacatcacgcccaagaactccaacaacaaggtggtgctccagagcgtctccccctggcgcgccgacgtgtacttcaacaagaccaccgggaagtacgaaatcctgggcctgaagtacgccgacctccaattcgagaaggggaccggcacgtacaagatcagccaggagaagtacaacgacatcaagaagaaggagggggtggacagcgactccgagttcaaattcaccctgtacaaaaacgacctgctcctgatcaaggataccgagaccaaggagcagcagctattccggttcctcagccgctccatgccgaacaagaagcactacgtagaacttaagccctacagcaaggacaagttcgagaagaacgagacgctgatcgagatcctcggtcccaccgacaagtccggccggtgcatcaaggggctggccaagagcaacctgtccatcttcaaggtgcgcaccgacatcctcggcaaccagcacatcatcaagaacgagggggacaagcccaagctggacttctga

SEQ ID NO: 7453 - RNA, 3387 nt, synthetic construct
  misc_feature 1..3387: note = Cas9 variant
  source 1..3387: mol_type = other RNA
atgaccaagatcctgggcctcgacctggggaccaacagcatcggctgggccgtggtcgacgagaagaaggagaagatcctgggaatgggctcccgtatcttccccgagggggtggtgaacatcggcgagggcgaggggcgggagacttctaagaacgcctcccgcaccgacgcgcggggcacccgccggcagttcttccgccggcgccttcggaagcgctacttactgcgggagctcgccaagaaggggctgtgcccgatcaactacaccctggtcaaggagtggaacgaggcccagatcttcaagaacaagcagctccaggagtggttcaagctgaacccctacgagctgcgcagcaaggccatccaggagaagatcagcctcgaggagctgggccggatcttctaccacttcatccagcgccgggggttccagagcaactcccgcagcgccggcgtggacaacatcgagaagtccgtgatttttaagggcgacacgaagaccgggaagatcggcatcagcgagaccctggagtccatcaagaacaccaagacgctcgggagctacttgcacaccatctaccccaagcagaacaagccctactccggccacaaggagcggatccgcaaccggtacaccacccgccagatgtacatctacgagttcgagactatctgggagtaccagaagcagttctacagcgagctgtccaacgagctcaagaccgtcctgggcgggcggaagaaggacggctacaaggaggacgggatcctgttccaccagcgcccgctccgcagccaaaagcacctggtgggctactgctcctttgagcccaagaagaccaagtgccagatcaacacaatccccttcgagctgttccggatctaccagtgggtgaatacggtggactgcaacgagaaggtgaccagcgaggaccgcgggaagatggtggagctcctgctgtccaaggagaaggtcagcttcaaagaaatccggaaggtgataaacaagagcgacggctactaccagttcaactacaagaacgacgacaagatcgtgggctcctacaccatcagcaacctttccaacaagaaattcttcgggaagaagtggttcgacttcagcgacaaggagcaggaagacatctggcacgtcctgtccttcttcgacgaccgcgacaagctgaagcagtacgcgataaagtactggggcttcaatgaggagaaggccgtgaagatcagcaagttcaacctcaaggaggggtactccaacttaagccggaaggccatccacaacatcctgcccttcctcaaactgggcttcatgtacgacgtggccgtcgggctaggcggcgtgaagaacgcgcttgccgacaagtggatcgagaacgagcagttcatcctggacaacgtgccgtccgtcgtgcgcagcaacttcaagggcgggtacatcgagcccctgaagcagatgctcaagtacgagttcgacgtgtccgacaagcagctgctgaagctctaccaccacagctccgccatcgagaccacggaactgctgaagaagctccccatcaacagcgaggccgacaaggagatccagtccatcaagaaccccgtcgtgatcaccgcgcttttcgagatccggaaactggtcaacgagatcatcgatacctacgggaagtttgacgagatcaaggtggagctcgcgcgcgatctgaaggcctcgaagtccaagcggtacgacacccgccgggaacagctgcgcctggagaaggagaacgaccggatcaagatcgagctcgagaacctgggccagcgaatcaaccacatcacgatcctgaagtacaaactctgggaggagtgcgacaagcggtgcccgttcaccgggaagaacatcgaggtgaacgagctgttcagtggcgaggtccagatcgagcacatcttcccctggtcccgcagcctgaacgacagcttcatgaacaagaccctctgcttcgccgacgagaaccgggcaaagggcaacaagaccccctacgagttctactctgagcagggggagcagaagtgggaggagatcaagatccaggcactgagctgcttcaagaacaagccaaactacccaaacgcgtaccagaagttcaagcagttcgtgaagaagaagcacgacgaggacttcatctcccgccagctgaacgacacgcggtacatcagcaaggaggccaagaactacctctccaagatctgcaacaacgtgcaggttgcccccggccagatgaccgccaccctgcgccacaagtggggcctgaacaccatcctcaacaaggacgacgacacgaagacccgcgacgaccaccgccaccacgccatcgacgcgctggtgatggcctgcagcacccgctcccacctccaggagctgagtaagcggaaccgctaccagaaggactacgagttcaaggacttccccatgccctggcagttcttccggcaggacgccgagaagtccgtggagcagatcctggtcagccacaagaagctgaacaccatcctcacggtgcgcacccacaagacaaagaagaacggcgtggtctacaagaatatcggcgtggccgcccgggggcagctgcacaaggaaaccgtgttcggcaagcgcaccgcgccggacgggatcgaggcctaccacgtccggaagccgatcgagtccctaagcacgcacaagcacatcaacaaggtagtggatgagaccatccgcctcctgatcctgaagcaggtcaacaagctcggcgggttcgtgaagggtaagatccccgagggcaccttctacaacaccgacgagaacgggaacaagcagccccagattttcctgccgaacaagaacggcaaccccgtgcccatcaagaagatccggctccgcgaaaacatcgggggcgccgaacagctcaagtccacggtcaaccagcacgtgaacccccggagcaaccaccacgttctgatctacaaggacttcgacgacaacctgaaggagaaggtcgtgacattctggaccgccgtggagcgcaagaagcagaagcaggcggtcttccagcttccggagaacgggaaggagatcgtgaccacgctgcagatcaacgacatgttcctgctcggactgaaggacgacgagatcaactgggagcaccccaagttcaccctgctcaaggaacacctgtaccgggtgcagaagtttacctccggcgactactacttccgcaagcacatcgagagcaacctgaacggggagctcggcaaggcctaccagtacatcaaggggttcggcgaggggaagaccggctggaagacgtttaaccccatcaagatcaaggtcagtgtgagcggcaagatcgagaaggtgtga

SEQ ID NO: 7454 - RNA, 3390 nt, synthetic construct
  misc_feature 1..3390: note = Cas9 variant
  source 1..3390: mol_type = other RNA
atgaacggcctggtgctcgggctggacatcggcatcgccagcgtcggggccggcatcctgaagaaggacaccggggagatcatccacgcgaactcccgcctcttccccgccgccaccgccgacaacaacgtgttaaggcgcagctcccggcaggcccgccggagcacgcgccggaagcgccaccgggcggtgcgcctgcacgacctcttcgaggactacggcctgctgaccgacttctccaaggtcagcatcaacctcaacccgtacaagctgcgggtggagggcatggacatccagctgaccaccgaggagctgttcatcgccctcaagaacatcatcaagcgccgggggatctcctacctggacgacgccagcgaggacggcgtgaccgtctccagcgactacgggaaggccgtggaggagaaccgcaaactcctgtccgagcagacccccggccagatccagctggagcggttcgagaagtacggacaggtgcgcggggactttaccgtcgaggagaacggcgagaagcggcgcctgatcaacgtgttcagcacctccacgtaccggaaggaggcggagcgcatcctgcggaagcagcaggagttcaacaacaagatcaccgacgactttatcgacgattacctgaccatccttaccgggaagcgcaagtactaccacggccccgggaacaagaagtcccgcacggactacggccggtacaccaccaagaaggacagcgagggcaagtacatcacgctggacaacatctttggggtgctgatcggcaagtgcacgttctaccccgacgagtaccgcgccagcaaggcctcctacaccgcacaggagtttaacctcctgaacgacctgaacaacctcaccgtcccgaccgagacgaagaaacttagcgagaagcagaagaagaccatcgtggagtacgccaagaccgcgaagactctgggcgcctccacgctcctcaagtacatcgccaagatggtggacgccagcgtcgaccagatccacggctaccgggtggacgtcaacaaaaagcccgagatgcacactttcgacgtctaccgcaagatgcagagcctggagacctttaatgtgaacgagatgccccgggaggtgctcgacgaactggcccatatcctgaccctcaacacggaacgcgaggggatcgaggaggcgatcaacaccaagctgaagggcaccttcaaccaggaccaggtcctggagctcgtgcagttccggaagaacaactccagcttattctccaagggctggcacaacttcagcctgaaattaatgatggagctgatccccgagctgtacgccacctccgaggagcagatgacgatcctcaccagactgggtaagcagaagtccaaggagatctcgaagcggaccaagtacatcgacgagaaggagatcaccgaggagatctataacccggtggtcgccaagagcgtgcgccaggccatcaagatcataaacgaggccacgaagcagtacggcatcttcgaccacatcgtcatcgagatggcgaggctgaccaacgaggaggacgccaagaaagactacatcaagcgccagaaagccaatctcgacgagaagaacgccgccatggagaaggcggccttccaatacaacgggaagaaggagctgcccgactccatcttccacggccacaaggagctggccaccaagatccggctgtggcaccagcagggggagaagtgcctctacaccggcaagaacatccccatcagcgacctgatccagaaccagtacaagtacgagatcgaccacatcctgcccctctccctgagcttcgacgactccctgagcaacaaggtgctcgtgctggccaccgcgaaccaggagaagggccagcgcacgccgttccaggccctggaccggatggacgacgcctggtcctaccgcgagttcaagagctacgtcaaggattccaagctcctggggaacaagaagaaggactacctgctcacagaggaggacatcagcaagatcgaggtgaagcagaagttcatcgagagaaacctggtggacacccgctactccagccgggttgtgctgaacgccctccaggacttctacaagaaccaccacttcgacaccacgatcagcgtggtccgcggccaattcacctcccagctgcgccggaagtgggggctggagaagtcccgcgagacctaccaccaccacgccgtggacgcgctcatcatcgccgccagctctcagctgcggctgtggaagaagcagaacaaccccctcatcttctacaaggagggccagttcgtggactccgagaccggggagatcctgagcctgaacgacgacgagtacaaggagctcgttttcaaggccccctacgaccacttcgtggacacgttacgctccaagaccttcgaggacagcatcctgttcagttaccaggtggacagcaagtacaaccggaagatctccgacgccaccatctacgcgaccagaaaggccaagctcgacaaggacaagagcaaggagacgtacgtcctgtccaagatcaaggacatctacagccaggccggttacgacgccttcatcaagatctacaacaaggacaagtcaaagttcctgatgtaccacaaggacagccagaccttcgagaaggtgatcgaggagattctccggacctacccctccaaggagttcaacgacaagaacaaggaggtgccgtgcaaccccttcgagaagtaccgccaggagaacggccccatccggaagtacagcaagaaggggaacggccccgagatcaagagcctgaagtactacgacaagaacatcccggagagcttcatcaacatcaccccctcgaactccaagaacaaggtcatcctgcgccagctcaacccctggcggacggacgtgtactttaaccaccaaaccgagaagtacgagctgctggggctcaaatacgccgacctgcagttcgagaagaagaccggcacctacagcatcactatcgacaaatacaacgagatcaaggagaaggagggcgtgggggagcagtccgagttcaagttcaccctgtacaagaacgacctcctgctgatcaaggacaccaagaacaacgagaagcagatcttccgcttccttagccggaccatgcccaacgtcaagcactacgtggagctcaagccgtacaacaaggcgaagttcgacggcaaccagcccctgatcacgatcttcgggaacgtggccaagggcgggcagtgcctcaaggggctgaacaagcccaacatcagtatctacaagataaaaaccgacgtcctgggcaacaagtacttcatcaagaaggagggggacaagcccaagctcaagttttga

SEQ ID NO: 7455 - RNA, 3390 nt, synthetic construct
  misc_feature 1..3390: note = Cas9 variant
  source 1..3390: mol_type = other RNA
atggccgaccgcatcagcctgggcctcgacatcggggtggcctccgtcggcttcagcgtgctggacatcgacaaggggaaggtgatcgaactgggctctcgcctctttaacgcgaccgtcgccgaggggaaccaggaccggcggagcatgcgcggggcccggcgcctgctgaaccggaacaagcagcgaagacaagacaccggcaaactgttccagaagttcgggctcctggataacttcaacaaagacaacttctacgacacgttcaaccagaactggaacccctacgagctccgcgtgaagggcctgaccgagcacctgaccaagaaggagctcgccgagagcctgtaccagatcgtgaagcaccgggggatcagctacgccctgaaggacgcggacgccgacgagggcgggaccgattactccgcgagcctcaagatcaactcccaggagctggctgagaagacgccggcgcagatccagctgcagcgcctcaacgactacggcaaggtcagaggccaggtggtgatcggggacgaccccgacaaccagaaggtcttgctgaacgtattccccaccagcgcgtacgagaaggaggccaaacaaatcattgccacccagaaacagttctaccccgagatcctcaccgacgagttcacgaaggagtactgcaagatcctgacccgcaagagagactacttcgtgggcccggggaacgagaagtcccgtaccgactatggcatctacaagaccgacggccggacgctagacaacctcttcgaagagttgatagggcacgacaagatctaccccgacgagttgcgcgctagcgcggcatcctacaccgcccagctgttcaatgtcctcaacgacctgaacaaccttcggatcctgagctacgaggacggcaagctgaccaaggaggacaaggagaagatcatcgccgagatcaagtccaacaccacaaccatcaacatgctcaacgtgatcaaaaaggtggccgggtgcagcaaggaggacatcaagggcttccgcgtcaacgagaaggacaagcccgagatctccagcatggcagtgtaccggaaggttcacaaggacttactaaaggtcggggtggacatcagcgactggcccgtggagttcatcgacaagctcagcttcatcctgaccctgaacacagagaacggggagatccgcaagcaactcaacaaccgcctggtcccggagttcgacttcttgaacgacgaccttatccagctgatcatcgacaataaggatagctttgaaatcaagacgaacaataagtggcaccggttctccctgaagaccatgaacaagctcatgcccgagatgctggagcgccccgtggagcaaatgaccctgctcaacgagatgggcctggtgaagaaggacaagaagcggttcgagaacaacaaatacctgccctacaaggagatcgccaaggacatcttcaatccggtcgcaagcaaatccgtgcgcgaggccctgaaaatcgtcaacgccgtgctcaagaagtatgggcacatcgactacctggtgatcgagatgccccgggacaagaaccttaaggaagaacaggacaacataaaggagttccagaataagaacaagaaggcgaaggacgccgccttcgaggccttcgtcaagagcgtcggctccgagcagcgcgtgaaggaagccctcagcaaaaaccgaaagctgcagatgaagatgcgcctttggtaccagcagcaggaaatcgacccctacaacggggagacgatcgacgcgacggacctcatcaacaaccccgacaagttcgaaatcgaccacatcatcccgcagtccatcagcttcgacgactccatcaacaacaagaccctgtgcttcgccagcatgaaccaggtcaaaggccagaagaccccttacgagttcatgctggaggggcacggccagggctacgacaagttcaaggccaccgtgctcgacaacaagaacttcgaccggaacaagcgcaagaactacctgttcgaggagaacgtgtccgacatcgaaacccggaagagatttcttagccggaacctcgtcgacacccgctactccagccgggtggtgctgaactccctgcaagatttcttccacgagaagtccgccgacaccaaggtcaccgtgatccgcgggaagtttacgagcaacatgcggaagcactggcacatcgacaaaacccgcgaaaccttccaccatcacgcgatagacgccagcatcatcgccgccaccccctttctccggatgtggaaaaagggagggacgatcttccccgtgaaggtcggcgaggagtcgattgacattgagaccggggagattctggacgacaagaagtttgacaaggtgatgtacgaggagccgtacaacggcttcgttagcgagatcatgaacgcggacgaccgcatcaagttcagccatcaggtcgacaaaaagatgaaccgcaaggtgtcagacgcgaccatctacagcacccggaccggcaagctggccaaggacaagaaggacgccgagtacatcgtggccaaggtgaaggacatatactccgtggacgggttcaagaagttcaagaaagtgtacgataaggacaagagcaagttcctcctgtacaagtacgacccacgcacgttctccgagctggagcggatcatcagcgactgccccgacaaggtcgagaaggtgcagaccaacggcaaggtgaaggccgtcgacgtgtcccccttcgagatgtacagacggtaccacggaatgataaagaagtacagcaagaaagggaacgggccggcgataaagcagctcaagtacctggataagaagttggggtcccacatcgacataacccccgccaacgcaaacggcaagcacgtgatccttcaaagcctgaaaccctggcgcacggacgtctacctgaaccatgagacgggggagtacgagatcatgggcatcaagtactcggacctcaagttcaacaagaacgtggggtatggcatcaagaaggataagtacctggagatcaagaagaacgaggaagtgagcgagaagtccgagttcatgttcagcctgtaccggaaggaccgcgtccggatccagaacatgaagaccggcgagtcggtggagctcctgttctggagccgtaacttctccaacaagaagtacgccgaactgaagcccatcttcaagttcgtgactgaggacgacgactggccggtctacggtcatgccaagacacagatcctcaagcggctggtgcccaaggactgtaagatctggaaggtgaacacgactatcctgggcgacccctactacctcgagaaggagagcgacaacccgaaggacatcctggactga

SEQ ID NO: 7456 - RNA, 3390 nt, synthetic construct
  misc_feature 1..3390: note = Cas9 variant
  source 1..3390: mol_type = other RNA
atgaccaacggcaagatcctggggctcgacatcggcatcgccagcgtgggggtcggcatcatcgaggccaagaccgggaaggtggttcacgcgaactcccgcctgttcagcgccgcaaacgcggaaaacaacgccgagcggagaggcttccggggttcccgccggctgaaccgccggaagaagcaccgcgttaagcgggtgcgcgacctcttcgagaagtacgggatcgtgacggatttccggaatctgaacctgaacccctacgagctccgcgtcaagggcctgaccgagcagctgaccaacgaggagctgttcgcggcgctccggaccatcagcaagcgccgggggatatcctacctggatgacgccgaggacgacagcacgggctccaccgactacgccaagagcatcgacgagaaccgcagactcctgaagaccaagaccccgggtcagatccagctggagcgcctcgagaaatacggacagctgcggggcaacttcacggtgtacgatgagaacggggaggcgcaccgcctgatcaacgtattctccaccagcgactacgagaaggaagcccggaagatcctcgagacccaggccgactacaacaagaagatcaccgccgagttcatcgacgattacgtcgagatcctgacgcagaagcgcaaatactaccacggccccgggaacgagaagtcccgcaccgactacggtcggttccgcaccgacggcaccacgctggagaacatcttcgggatcctcatcggcaagtgcagcttctaccccgacgagtaccgggcctccaaagcgagctacaccgcccaggagtacaacttcctgaacgacctgaacaacctcaaggtgcccaccgagaccgggaagctgagcacggagcagaaagaggccctggtggagttcgccaagagcaccgccaccctcggcccggcgaagctgctgaaggagatcgccaagatcctcgactgcaaggtcgacgagatcaaggggtaccgcgaggacgacaagggcaagccggacctacacacctttgagccctaccggaagctgaagttcaacctcgactccgtgaacatcgacgacctgagccgcgaggtgctggacaagctcgccgacatcctgacgctgaacaccgagcgggagggcatcgaagacgccatcaagcgtaacctcccgaaccagttcaccgaggagcaaatctccgagatcatcaacgtccgcaagagccagagcaccgccttcaacaaggggtggcactccttcagcgcgaagctgatgaacgagctgatcccggaactctacgccacgtccgacgagcagatgaccatcctgacccggctagagaagttcaaggtgaagaaaaagtccagcaagaacatcaagaccatcgacgagaaggagatcacggacgagatctacaaccccgtggtcgccaagagcgtgcggcagacgatcaagatcatcaacgccgccgtgaagaagtacggcgacttcgacaagatcgtcatcgagatgccccgcgacaagaacgcggacgacgagaagaagttcatcgacaagcggaacaaggagaacaagaaggagaaagacgacgccctcaagcgcgccgcctacctgtacaatgggaccgacaagctgcccgacgaggtgttccacgagaacaagcagttagagaccaagatccggctgtggtaccagcagggcgagcgctgcctgtactccgggaagccgatccccatccaggagctggtgcacaactcgaacaacttcgagattgaccacatcctccccctgtccctgagcttcgacgactccctcgcgaacaaggtcctggtgtacagctggacgaaccaggagaagggccagcggaccccctaccaggtcatcgactccatggacgccgcctggagcttccgcgagatgaaggactacgtgctgaagcagaagggcctcggaaagaagaagcgggactacctgctgaccaccgagaacatcgataagatcgaagttaagaagaagttcatcgagcgcaacctcgtcgacacccgctacgcctcccgggtggtgctgaacagcctgcagtccgccctccgcgagctgggcaaggacacgaaggtcagcgtggtgcgggggcagttcacctcccagctgcgccggaagtggaagatcgacaagagccgcgagacctaccaccaccacgctgtcgacgccctcatcattgctgccagctcccagctgaagctgtgggagaagcaggacaacccgatgttcgtggactacggcaataaccaggtggtcgacaagcagaccggtgagatcctcagcgtatccgacgacgagtacaaggagctggtgttccagccgccctaccagggctttgtcaacacgatctcgtccaagggcttcgaggacgagatcctgttcagctaccaggtggacagtaagtacaatcggaaggtgagcgacgccaccatctacagcacccgcaaggcgaagatcgggaaggataagaaggaggagacctacgtcctcggcaagatcaaggacatctacagccagaacgggttcgacacgttcgtgaagaagtacaacaaggacaagacccagtttcttatgtaccagaaggaccccctgacctgggagaacgtgatcgaggtcatcctccgggactaccccaccacgaagaaatccgaggacggcaagaacgacgtgaagtgcaaccccttcgaggagtaccgccgggagaacggcctgatctgcaagtacagcaagaagggcaagggcacccccatcaaatccctgaagtactatgacaagaagctcgggaactgcatcgacatcacaccccaggagagcaagaaccgcgtggtcctgcggcagatctccccgtggcgcgccgacatctacttcaaccccgagaccctgaagtacgagctcatgggcctgaagtacagcgacctatccttcgagaaggggaccggcaagtaccacatcagccaggagaagtacgacgccatcaaggagaaggaaggcgtgggaaaggacagcgagttcaagttcaccctctaccggaacgacctgatcctgatcaaggacaccctcaacaactgcgagcgcatgctgcggttcggctccaagaacgacaccagcaagcactacgtggagctgaagcccctcgagaaggggacgttcgactccgaggaggagatcctgcccgtcctgggcaaggtggccaagagtgggcagttcatcaagggcctcaacaagccgaacatctccatctacaaggtgcgcaccgacgtcctgggcaacaagtacttcgtcaagaaggagggggacaagcccaagctggacttcaaaaacaacaagaagtga

SEQ ID NO: 7457 - RNA, 3390 nt, synthetic construct
  misc_feature 1..3390: note = Cas9 variant
  source 1..3390: mol_type = other RNA
atgagcaacggcaagatcctggggctcgacatcggcgtggcctccgtcggagtgggcatcatcgactcaaagaccgggaacgtgattcacgccaactcccgcctgttcagcgcggccaacgccgagaacaatgccgagcggcgcggcttccggggcgcccgccggctgacccgccggaaaaagcaccgcgtcaagcgggtgcgagatctctttgagaagtacgacatctccacggacttccggaacctgaacctgaacccctacgagctccgcgtgaaggggctgaccgagcagctcaccaatgaggagctgttcgcggcgctccggaccatcgccaagagacggggcatcagctacctggacgacgccgaagacgactccacagggagctccgactacgccaagtcaatcgacgagaaccgccgcctcctcaagacaaagaccccgggccagatccagctggagcgcctcgagaagtacggacagctgcggggcaacttcaccgtttacgacgagaacggcgaggcgcaccgcttgatcaacgtgttctccaccagcgactacaagaacgaggccaggaagatcctcgagacccagtccaactacaacaagcagatcaccgacgagttcatcgaagactacatcgagatcctgacgcagaagcgcaagtactatcacgggcccggcaacgagaagtcccgcacggactacgggcggttccgcaccgacggcaccaccctggagaacattttcggcatcctcatcgggaagtgcagcttttacccagaggagtaccgggccagcaaagcatcatatacggcgcaggagttcaacttcctgaacgacctgaacaacctcaaggtgcccaccgagaccggcaaactgagcaccgagcagaaggagtacctggtcgacttcgccaagaagtccaaggccctcggggccagcaagctgctaaaggagatcgccaagatcgtggattgcagcgtggacgacattaagggctaccgcgttgacaacaaggacaagcctgacctccacaccttcgagccctaccggaagctgaaattcaacctgagtagcatcgacatcgacgaactcagtcgcgagaccctggataaactggcggatatcttaaccctgaacaccgagcgggaggggatcgaggacgccatcaagcgcaacctgcccagccagttcacggaggagcagatctccgagattgtacagatccggaagaaccagagctccgccttcaacaagggctggcacagcttctccgccaagctcatgaacgagctcatccccgagctttacgttaccagcgaggagcagatgacaatcctcacccgcttggagaagttcaaggtcaacaagaagtccagcaagaacacgaagaccatcgacgagaaggagatcaccgacgagatctacaacccggtggtggccaaatccgtcagacagaccatcaagatcataaacgcggccgtgaagaagtacggagacttcgacaagatcgtgatcgagatgccccgcgacaagaacgcagaggacgagaagaagttcatcgacaagaagcagaaggagaacaagaaggaaaaggacgactcactgaagcgggccgccttcctctacaacgggacggacaacctccccgacggtgtgtttcacgggaacaaggagctgaagaccaagatccgcctctggtaccaacagggcgagcgatgcctgtactcagggaagctgatctcgatccacgacctggtgcacaactccaacaagttcgagatcgaccacatcctccccttgagcctgtccttcgacgatagcctcgctaacaaggtgctggtctacgcgtggaccaaccaggagaagggccagaaaacgccgtatcaggtgatcgacagcatggacacggcctggtccttccgcgagatgaaggactacgtcctgaagcagaagggtctcggtaagaagaagtgcgagtatctgcttaccaccgagaacatcgacaagatcgaggtgaagaagaagttcatcgagcggaacctagtggacaccaggtatgcctcgcgggtcgtgctgaactccctccaaaccgcgctaaaggagctgggcaaggacacgaaggtgagcgtggtgcgcgggcaattcacgagtcagctgcgccgcaagtggaacattgacaagagccgggagacctaccatcaccacgccgtggacgccctcatcatcgcagcctccagccagctgaagctgtggcagaagcaggagaaccccatgttcgagagctacggcgagaaccaggtcgtcaacaaggagaccggggagatcctcagcatctccgacgacaagtacaaggagttggtattccagccgccctaccagggcttcgtcaacacgatcagctccaagggcttcgaggacgagatcctgttcagctaccaggtggactccaagttcaaccggaaggtgagcgacgcgaccatctactccacccgcaaagccaagctggggaaggacaagaaggacgagacgtacgtcctgggcaagatcaaggacatctacagccaggacgggttcgacacgttcatcaagcggtacaagaaggacaagacccaattcctgatgtaccagaaggaccccctcacctgggagaacgtgattgaggttattctgcgcgactaccccagcgagaagctgtctgaagacggcaaaaagaccgtgaagtgcaacccctttgaagagtaccggcgcgagaacggcctcatctgcaagtacagcaagaaggggaacggcacgcccatcaagagcctgaagtactacgacaagaagctggggaactgcatagacatcacccccgagaagtccaagaaccgggtggtgctccgccagatcagcccttggcgggcggacatctacttcaacctggagaccctgaagtatgagctcatgggcctgaagtacagcgacctgtccttcgagaaggggaccggcaaataccacatctcgcaggaaaagtacgacgccatccgcgagaaggagggcatcgggaagaagtccgagttcaagttcacgctctaccggaacgacctgatcctgatcaaggacaccctcaacaactgcgagcgcatgctgcggttcggctcgaagaatgacacctccaagcactacgtcgagctgaagcccctcgagaaggggaccttcgacagcgaggaggagatcctgcccgtgctgggcaaggtggccaagtccgggcagttcatcaagggcctcaacaagccgaacatcagcatctacaaggtccggacggacgtgctgggaaacaagttcttcatcaagaaggagggggacaaacccaaactggacttcaaaaacaacaacaagtga

SEQ ID NO: 7458 - RNA, 3390 nt, synthetic construct
  misc_feature 1..3390: note = Cas9 variant
  source 1..3390: mol_type = other RNA
atgagcaacggaaagattctggggctcgacatcggcgtggcctcagtcggggtgggcatcatcgacgccaagaccgggaacgtgatccacgcgaacagccgcctgttttccgccgccaacgccgaaaacaacgccgaacggcgcggcttccggggcgcacgccggctgacccgccggaagaagcatagagtcaagcgggtgcgtgacctcttcgagaagtacgacatcagcacggacttccggaacctgaatctgaacccctacgagcttcgcgtgaaggggctgaccgagcagctgaccaacgaggaactgttcgccgccctccggaccatcgccaagcggaggggcatctcctacctggacgatgcggaggacgacagcacggggtccagcgactacgccaagtccatcgacgagaaccgccggctccttaagaccaagaccccgggccagatccagctggagcggctcgagaagtacgggcagctgcggggcaactttaccgtctacgacgagaacggcgaggcccaccgcctgatcaacgtgttcagcacatccgactacaagaacgaggcccggaaaatcctcgagacccagagcaactataataagcagatcaccgacgagttcatcgaggactacatcgagatcctcacccagaagcgcaaatactaccacgggcctggcaacgagaagtcccgcacggactacggtcggttccgcaccgacggcaccacactggagaacatcttcgggattctgatcgggaagtgcagcttttaccccgaggagtaccgggcctccaaggcgagctacacggcccaggagttcaacttcctgaacgacctgaacaacctcaaagtgcctaccgagaccggcaaactgagtaccgagcaaaaagagtatctggtcgacttcgccaagaagtccaaggccctcggggccagcaagctgctgaaggagatcgcgaagatcgtggactgcagcgtggacgacatcaagggctaccgcgtcgacaataaagacaagccggacctccacacgttcgagccctaccggaagctgaagttcaacctgagctccatcgacatcgacgagctcagccgcgagaccctggacaagctggccgacatcctcaccctgaacaccgagcgggaggggatcgaggacactatcaaacgcaacctgccctcccaatttaccgaggaacagatcagcgagatcgtgcagatccggaagaaccagtccagcgcctttaacaagggctggcactccttcagcgccaagttaatgaacgagctgatccccgagctgtacgtgacctccgaggagcagatgaccatcctcacgaggctggagaagtttaaggtaaacaaaaagagcagcaagaacaccaagaccatcgacgagaaggagatcaccgacgagatctacaacccggtggtggccaagagcgtccggcagacgatcaagatcatcaacgcggccgtaaagaagtacggagacttcgacaagatcgtgatcgagatgcccagagacaagaacgccgaggatgagaagaagttcatcgacaagaaggagaaggagaacaagaaggagaaggacgattccctgaagcgggccgccttcctctacaacgggaccgacaatctgcccgacggcgtcttccacgggaacaaggagctgaagaccaagatccgcctatggtaccagcagggcgagcggtgcctgtacagcgggaagctgatctccatccatgacctggtgcacaacagcaataaattcgagatcgaccacatcctccccctgtccctgagcttcgatgactccctcgcgaacaaggtcctggtatacgcctggaccaatcaggagaagggccagaagacgccgtaccaggtgatagacagcatggacgccgcctggagcttccgcgagatgaaggactacgtcctgaagcagaagggcatcgggaagaagaagcgggaatacttgctgaccaccgagaacatcgataaaatcgaagtgaagaagaagttcatcgagcgcaacctggttgacacccggtacgcttcccgcgtcgtgctgaacagcctgcagaccgccctgaaggagctcggcaaggacacgaaggtgtccgtcgtacgcgggcagttcacctcccagctgaggcgcaagtggaagatcgacaagtcccgggagacctaccaccaccatgccgtggacgccttgatcatcgccgcgagcggccagctcaagctgtggcagaagcacgagaacctgatgttcgagaactatggggagaaccaggtcgtgaacaaggagaccggcgagattctctccatcagcgacgacgagtacaaggagctggtgttccagccgccctaccagggcttcgtcaacacgatctccagcaagaccttcgaggacgagatactgttctcctaccaggtcgacagcaagttcaaccgcaaagtgtccgacgccaccatctacagcacccggaaagctaagctcgggaaggacaagaaggaggagacgtacgtcctgggcaaaatcaaggacatctacacccaggacggattcgacacctttatcaagagatacaagaaagacaagacccagttcctgatgtaccagaaggaccccctcacgtgggagaacgtgatcgaggtgatcctgcgcgactacccttccgagaagctgagcgaggacggcaagaagaccgtcaagtgcaacccattcgaggagtaccgccgggagaacggcctcatctgcaagtactccaagaaggggaacggcacccccatcaagagcctgaagtactacgacaagaagctggggaactgcatcgacatcacccccgaaaagtccaagaaccgcgtggtgctacggcagatcagcccgtggcgcgctgacatctactttaacctggagactctgaagtacgagctcatgggcctgaagtacagcgatctttccttcgagaagggtaccggcaagtaccacatcagccaggagaagtacgatgccatccgggagaaggagggcatcgggaagaagtccgagttcaagttcaccctctaccgcaacgacctaatcctgatcaaagatacgctcaacaactgcgagcggatgctgcgcttcggcagcaagaacgacacctccaagcactacgtcgagcttaagccgctcgagaaggggacattcgacagcgaggaggagatcctgcccgtgctgggcaaggtagcgaagtccgggcagttcatcaagggccttaacaagcccaacatttcgatctataaggtccggaccgacgtgctgggcaacaagttcttcatcaagaaggaaggggacaagccgaagctagacttcaagaacaacaacaagtga

SEQ ID NO: 7459 - RNA, 3393 nt, synthetic construct
  misc_feature 1..3393: note = Cas9 variant
  source 1..3393: mol_type = other RNA
atgaacaagatcctgggcctcgacctggggaccaatagcattggttgggccctgatcgagaacaacatcatcttggggatgggctcacgcgtgttccccgagggggtcgtgaacctgggcgagggcgaggggcgggaaaccagcaagaatgcctcccgcacggaggcgcggggagtgcgtcggcagatctttcgcagacgcctgcggaagcgataccttctgaaggaactggccaagcacaacctctgcccgatctcccccaccctgatcaaggactggaacgggaccgacatctttaaaaacgagctaatcatccagtggttccagctcaacccctacgagctgcgggccaaggcgatccaagaggagatcaccctgatcgagctcggccgcatcttctaccacatgatccagcggcgcgggttcctgtcgaacagccggtccgccggcgcggacgtcaaggagacttccaccatcttcaagggcgacgccaagatcgggaagatcggcatctccgacaccctcaaatccatcgagcagaacaagactctcgggtccttcctgcacagcatccagcccaaggagaacgagccgttctccggcgaactggagcgcatccggaaccgctacacgacccggcagatgtacatcgatgagttcgagaccatctgggagtttcagaagcagtaccacagcgagctcaactccaacctgaagaccatcctgggcgggcgcaagaaggacaactacaaggaggacggggtgctgttccaccaacggcccctgcgcagccagaagcacctggtggggttctgctccttcgagcccaagaagacgaagtgcaagctcagcgccatcccgttcgagctgttccgcatctaccagtgggtcaacaccctgtcctacgacgtgaacggagtgcggcagaaaatcacgcaagaggagcgcaagaaaatcattgatctcctgctaagcaaagagaagccgagcttcaaggagatccggaaggccatcgggaagctcgacggctcctaccagttcaactacaaggacgacgacaagatcgtcggcagccacaccatttccaaccttagcaacaagaagtttttcgggaataagtggttcgatttctccgagaaagagcaggagaacatctggcacatcctcagcttcttcgacgacagggagaaacttaaggagtacgcgatcaagaactggtccttcgacgaggagcgggccgtcaagatcagcaagttcaacttaaaggatggctactccaacctgagccgcaaggccatcctcaacatcttacccttcctgcaaaaggggttcatgtacgacgtggccgtgggcctcgccggggtgaagaacacgctgtccgtgaactgggaggagcacgaacagttcgtcctggacaacgtgcccgagatcgtgcggagcaacctcaagggtggctacatcgagcccctgaagaacatgctgaagaacgagtttaactgcaacgataagcagctcgagaagctgtatcaccactcgagcgcgatcgagaccgagaacatcctggaccgcttaccggtcaacctccacgccgaccgggagatacagaagatcaagaatcccgtggtgatcacggccctgttcgagatccgcaaactggtcaacgaggtaatcgacacctacgggaagcccaacgagataaaggtggagcttgcccgggacttgaaggcctccaagagcaaccgcttagaggcgcggaaacgccagaaggacctcgagaaacagaacgaccgggtcaagctggaactggagaacctcaaccagaggtccaatcacatcaacatcctgaagtacaagttatgggaggagtgcaaccacacgtgccccttcaccggccagattatcaccattagccagctgttcaccggggaggtacagatcgagcacatattcccttggtcccggagcctaaacgacagtttcaacaacaagacgctgtgcttcgccgatgagaaccgcgccaaaggcaacaagaccccctacgagctatactccgagcagggggaccaaaagtgggaggccatcaagctacaagccctgagctgcttcaagaccaaagcgaactaccccaactgctacaacaagttcaaacacttcgtcaagaagaagcacgacgaggacttcatctcccggcagctcaacgacacccgctacataagcaaagaggccaagaattacctgtccaagatctgcagcaacgtgctggtggcccccggccagatgacggccaccctccgccaccactgggggctaaactccatcctgaatctcgaggacgacaccaagacccgggacgaccaccgccatcacgccatcgacgcgttagtcatggcctgcagcacgcggtcccacctccaggaactcagcaagcgcaaccggtacaacaagaactacgacctgaaggacttccccgacccttggcagaacttccgccaggacgccgagaacgccgtggcgcagatcctggtgtcccacaagaagtccaagtcacttctgaccgtccggacccacaaaaccattaagaagggagtggaacacaagaacatcggcgtggccgcccgcgggcagctgcacaaggaaagcgtctacggcctccggaaagcccccaactccaacaaggccttccacatccgcaagcccctggaaagcctgaccaccgagaaacagctcgagaagatcgtggacgactccatccgtctgctgatcctcaagcgcatcaatatcatcgggggattcatcaaaggcaagatcccgaaggagaccttcttcgtggtcgacgagaacgggatcaagcagccccagatcttcttacccaaccggaacggcaaccccgtgccgatcaagaaggtgcgcatccgggagaacatcgggggcgcggagaagctgaaggagaacaccaaccagtacgtcaacccccgcagcaaccaccacgtcatcgtgtacgaggactcgaacgggggcctcaaggacgacgtcgtgaccttctggacggccgtggagcggaagagacagggccaggacgtcttcaagctgcccaacgacggggagaagatcgtgtccacactgcagatcaacgacatgttcctcctgggcctgaacgacgacgatatcatcaccctcaccagcaaggagctgaagaagcacctgttcaaggtgcagacgctctccagctccttctacgagttccggctgagcaccgactccacccaaaacaagaacaccaacagcacggttttccgccggatacagtccttcggtatggggaagaccggttggaaggccttcaacccgatcaaggtgaagctgaacagcatcggggaggtgaagatcatctga

SEQ ID NO: 7460 - RNA, 3393 nt, synthetic construct
  misc_feature 1..3393: note = Cas9 variant
  source 1..3393: mol_type = other RNA
atgaccaatggaaagatcctggggctcgacatcggcatcgccagcgtgggggtcggcatcatcgaggcaaagaccgggaaggtggtgcacgcaaactcccgcctgttctccgccgccaacgccgagaacaacgccgagcggcgcggcttccggggctcccgccggctgaaccgccggaagaagcaccgcgtcaaacgggtgcgcgacctcttcgagaagtacgggatcgtgacggacttccggaacctgaacctgaacccctacgaactccgcgtcaagggcctgaccgagcagctgaccaacgaggagctgttcgcagccctccgcactatcagcaagcgccgggggatctcctacctggacgacgccgaggatgacagcacgggctccaccgactacgccaagagcatcgacgagaacagacggctcctgaagactaagaccccggggcagatccaactggagcgcctcgagaagtatggccagctgagaggcaacttcacggtatacgacgagaacggggaggcgcatcgcctgatcaacgtgttctccacctctgactacgaaaaggaggccagaaagatcctcgagacccaagccgactacaacaagaagatcaccgctgagttcatcgacgactacgtcgagattctgacgcagaagagaaagtactaccacggccctgggaacgagaagtcccgcaccgactacggccggttccgcaccgacggcactacgctggagaacatattcggcatcctcatcggcaagtgtagcttctaccccgatgagtatcgggcctccaaggcgagctacaccgcccaggagtacaactttctgaacgacttaaacaacctcaaggttcccaccgagaccggtaagctgtccacggagcagaaggaggccctggtggagttcgccaaaagcaccgctactctaggcccggcgaagttgctaaaggagatcgccaagatcctcgactgcaaagtcgacgagatcaaggggtaccgcgaggacgataagggcaagcccgacctgcacaccttcgagccgtaccggaaactgaagttcaacctcgactccgtgaatatcgacgacctgagccgcgaggtgctggacaagctcgccgacattctgacgctgaacaccgaacgggaaggcatcgaggacgccatcaagcgcaacctccccaaccagttcaccgaggagcaaatatccgagatcatcaacgtccggaaaagtcagtcgacggctttcaacaaggggtggcactccttcagcgcgaagctgatgaacgagctgatcccggagctctacgccacgtccgacgaacagatgaccatcctcacccggctcgagaagttcaaggttaagaagaagtccagcaagaacatcaagactatcgacgagaaggagatcacggacgagatctacaacccggtggtagcgaagagtgtccggcagaccatcaagatcatcaacgctgctgtgaagaagtacggcgacttcgacaaaatcgtcatcgagatgccaagagacaaaaacgcggacgacgagaagaagttcatcgacaaacggaacaaggagaacaagaaggagaaggacgacgcactcaagcgcgccgcctacctgtacaacgggaccgacaagctcccagacgaagtgttccacggcaacaagcagctcgaaaccaagatccgcctgtggtatcagcagggggagcgctgcctgtactccggaaaaccgatccccatccaggaactggttcacaacagcaacaacttcgagatcgaccacatcctccccctgagtctgagcttcgacgattccctcgcgaacaaggtcctggtgtacagctggacgaaccaggagaagggccagcggaccccctaccaggtcatcgactccatggacgccgcctggagcttccgcgagatgaaggactacgtgctgaagcagaaggggctcggcaaaaagaagcgggactacctgctgaccaccgagaacatcgacaagatcgaggtgaagaagaagttcatcgagcgcaatctcgtcgatacaaggtacgcctcccgggtggtgctgaacagcctgcagtccgccctccgcgagctggggaaggacacgaaggtcagcgtagtgcgtggccagttcacctcacagctgcgccggaagtggaagattgacaagagccgcgagacctaccaccaccacgcggtcgacgccctcatcatcgccgccagctcccaactgaaactgtgggagaagcaggacaacccgatgttcgtagactacgggaataaccaagttgtcgacaagcagaccggcgagatcctcagcgtgtcagacaatgagtacaaggagctggtattccagccgccctaccagggcttcgtcaacacgatcagctccaaggggttcgaggacgagatcctgttcagctatcaggtggactccaagtacaaccggaaggtgagcgacgccaccatctactccacccggaaagcgaagatcggcaaggacaagaaggaggagacctacgtcctagggaagatcaaggacatctacagccagaacggcttcgacacgttcgttaagaagtacaacaaggacaagacccagttcctgatgtaccagaaagaccccctgacctgggagaacgtgatcgaggtcatcctcggcgactaccccacaacgaaaaagtccgaggacgggaagaacgacgtgaagtgcaacccattcgaggagtatcggcgcgaaaacggcctaatctgtaaatacagcaaaaagggaaagggcacacccatcaaatccctgaagtactacgataagaagctcgggaactgcatcgatatcacccctgaggagagccggaacaaggtgatactgcagtccatcaatccgtggagagccgacgtctacttcaaccccgagaccctgaagtacgagctcatgggcctgaagtactcagacctgtccttcgaaaagggcacggggaactaccacatctctcaggagaagtacgacgccataaaggaaaaggagggcatcgggaagaagtctgagttcaagttcaccctctaccgcaacgacctgatcctaatcaaggacatcgccagcggcgagcaggagatctatcgcttcctcagccggacaatgcccaacgtgaaccactacgtggagctgaaaccctacgacaaggaaaagttcgacaacgtccaggagctggtggaggcgctcggggaggcggacaaagtaggccgctgcatcaaaggactgaacaagccgaacatctcgatctacaaggtccggaccgacgtgctggggaacaagtacttcgtgaagaaagagggcgacaaaccaaaactcgattttaagaataacaagaagtga

SEQ ID NO: 7461 - RNA, 3393 nt, synthetic construct
  misc_feature 1..3393: note = Cas9 variant
  source 1..3393: mol_type = other RNA
atgaccaacggcaaaatcctggggctcgacatcggcatagccagcgtgggagtcggcatcatcgaggccaagaccgggaaggtggtgcacgcgaactcccgcctgttcagcgcggccaacgccgagaacaacgccgagcggcgcggcttccggggctcccgccgtctgaacaggcgcaagaagcaccgcgtcaagcgggtacgcgatctcttcgagaagtatgagatagtgacggacttccggaacctgaacctaaacccctacgagctccgcgtcaaggggctgactgagcagctcaccaacgaggagctgttcgcggccctccggaccatctccaagcgacggggcatctcctacctagacgatgccgaggacgactccacggggtccaccgactatgcaaagagcattgacgagaaccgccggttgctaaagaccaagaccccaggccagatccagctcgagcgcctcgagaagtatgggcagctgcggggcaacttcacggtgtacgacgagaacggcgaggcgcatcgcctgatcaacgtgttctccaccagcgattacgagaaggaggcccggaagatacttgagactcaagccgactacaacaagaagatcaccgccgagttcatcgacgactacgtcgagattctgacacagaagcgcaagtactaccacgggcctggcaacgagaagtcccgcaccgattacgggcggtttcgtaccgacggcaccacgctggaaaacatcttcggcatcctaatcggcaagtgcagcttctaccccgacgaataccgcgcttccaaggctagctacaccgcacaggagtacaacttcctgaacgacctgaacaacctcaaggtgcccaccgagaccggcaagctgtccacggagcagaaagaggccttggtggagttcgcgaaatctaccgccaccttggggccggcgaagctgctgaaggagatcgcaaagatactcgattgcaaggtcgatgagataaagggctacagggaagacgacaagggtaagcccgacctgcataccttcgagccctaccggaagttaaagtttaacttggactccgtaaacatcgacgacctgtcccgcgaggttctggacaaactcgccgacatcttgacgctgaacaccgagcgggagggcatcgaggacgccatccgccacaacctccccaaccagttcacagagggccagatcagtgaaatcatcaaagtccgcaagagccagagcactgccttcaataaggggtggcacagcttcagcgcgaagctgatgaacgagctgatccccgagctctatgccacgtcagacgagcagatgaccatcctaacccggttggagaagttcaaggtgaacaagaagtccagcaaaaacaccaagacgatcgacgagaaggaagtgactgatgagatctacaaccccgtcgtggccaaaagcgtgcggcaaaccataaagatcatcaacgccgcggtcaagaagtacggcgacttcgacaaaatagtgatcgagatgccaagagacaagaacgcggacgacgagaagaagttcattgacaagcggaacaaggagaacaagaaggagaaggacgacgcactcaagcgcgccgcctacctgtacaacgggaccgacaagctgcccgacgaggtttttcacggcaacaagcaactcgagacgaagatccggctgtggtatcagcagggcgagcgctgcctctactctggcaagccaattcccatccaggagctggtccacaacagcaacaacttcgaaatagaccatattctccccctgtccctgagcttcgacgactccctcgcgaacaaggttctggtatacgcctggaccaaccaggagaagggccagaaaaccccctatcaggtgatcgacagcatggacgcggcctggtcgttccgggagatgaaggactacgtcctgaagcagaaggggctcggcaagaagaaacgcgactacctgctgaccaccgaaaacatcgataagatcgaggtcaagaagaagtttatagaacggaacctcgtggacactagatatgccagtcgcgtggtcctgaactccctgcagtcagcgctccgggagctggggaaagacactaaaatctccgttatccggggccagtttacctcccagctccgacgcaagtggaaaatcgacaagtcccgtgagacctaccatcaccacgcggtggacgccctcatcatagccgcaagcagtcaactgaagctgtgggagaagcaagacaaccctatgttcgtcgactacgggaataaccaggtggtcgacaagcagacgggggagatcctctccgtcagcgacgacgagtacaaggagctggtgttccaaccgccctaccagggattcgtgaacatgatctcctccaaagggtttgaagacgaaatcctgttctcctaccaggtcgacagcaagtacaaccgcaaagtctccgacgcaaccatctacagcaccagaaaagcaaagatcggcaaggacaagaaggaggagacctacgtgctcgggaagatcaaagacatctattcccagaacggattcgacacgttcatcaagaagtacaacaaggacaagacccagttcctgatgtatcagaaggacccactgacgtgggagaacgtaatcgaggtgatcctacgcgactaccccaccacgaaaaagtctgaggacggcaaaaacgacgtgaagtgcaacccctttgaggagtaccgccgcgagaacggcctggtctgcaaatatagcaaaaagggcaaggggacgccgatcaagagcctgaaatactacgacaagaagctcggtaactgcatcgacataacgcctgagggttccaaaaacgaggtggtgctgcaatcactgaacccgtggcgggccgacgtctacttcaacccagagaccctgaagtacgagctgttaggcctcaagtattccgatcttagcttcgaaaagggtacggggaagtaccatatctcccaagagaaatacgacgtcataaaggagaaggaggggatcgggaagaagtccgagtttaagttcaccctgtaccgcaacgacctgatactgatcaaggacaccgccagcggcgagcaggagatctacagattcctgagccggaccatgcccaacgtcaagcactacgccgaactcaagccctatgacaaggagaagttcgacaatgtccaggagctggtggaggcgctgggggaggccgataaagtgggccggtgcatcaagggcctcaacaagtcgaacctgtccatctacaaggtacgcaccgacgtgttaggaaataagtattttgtgaagaaggagggcgacaagccgaagctagacttcaagaacaacaagaaatga

SEQ ID NO: 7462 - RNA, 3393 nt, synthetic construct; identical to SEQ ID NO: 1662
  misc_feature 1..3393: note = Cas9 variant
  source 1..3393: mol_type = other RNA

SEQ ID NO: 7463 - RNA, 3393 nt, synthetic construct
  misc_feature 1..3393: note = Cas9 variant
  source 1..3393: mol_type = other RNA
atgagcaacggcaagatcctggggctcgacatcggcgtggcctccgtcggggtgggcatcatcgacgcgaagaccgggaaagtgatccacgcgtcatcccgcctgttcagtgccgccaacgccgagaacaacgccgagcggcgcggcttccggggcgcgcgccggctgacccgccggaaaaagcaccgcatcaagcgggtacgcgacctcttcgagaagtacgagatcgtgacggacttctccaacctgaacctgaacccctacgaactcagggtgaaggggctgaccgaacagctgaccaacgaggagctgttcgccgccctccgcaccatcgccaagcggcgcggcatcagctacctggacgacgcggaggacgactccacggggagctccgactacgccaagagcatcgaggagaaccggcgcctcctgaagaacatgacgccgggccagatccagctggagcggctcgagaagtacgggcagctgcgcggcaacttcactgtctacgacgagaacggcgaggcccaccggctgatcaacgtgttctccaccagcgactacaagaacgaggcacgcaagatactcgagacgcagtccaactacaacaagcagatcaccgacgagttcatcgaggactacatcgagatcctgacccagaaacggaagtactaccacgggcccggcaacgagaaatcccgcaccgactacgggcgctaccggacggacggcaccaccctggagaacatcttcggcattttgatcgggaagtgcacattctaccccgacgagtaccgtacgagcaaggccagctacaccgcgcaggagtacaacttcctgaacgacctgaacaacctcaaggtgcccaccgagaccggcaagttgtccactgagcagaagcactacctggtcgacttcgccaagagctccaaggccctcggcgtggcgaagctgctgaaggagatcgccaagatcgtggagtgcagcgtcgacgacatcaagggctaccgggaggacaacaaggggaagcctgatctccacaccttcgagccctaccgcaagctgaagttcaacctgagcctcatcgacatagacgagctgtcccgggagaccctggacaagctcgcggacatcctgacactgaacacggagcgcgagggcatcgaggacgctatcaagcggaacctccccaaccagttcaccgaggagcagatcgtggagctggtgaacgtccgcaagaaccagagctccgccttcaacaaaggctggcacagcttctccgtgaaactgatgaacgagctcatccccgagctgtacgccagctccgaggagcagatgaccatactgacccggctcgagaagttcaaggtgaacaagaagtccagtgagaacacgaagaccatcaacgagaaggagatcaccgacgagatctacaacccggtcgtggccaagagcgtgtcccagaccgtcaagatcatcaacgcggccgttaagaagtacggggacttcgacaagatcgtgatcgagatgccccgcgacaagaacgccgacgacgagaagaagttcatcgacaagaagcagaaggagaacgccaaggaggtcgaggacgcgctgaagcgggcggcctacctgtacaacggcacggacaagctcccagacggggtgttccacggcaacaagcagctgaagaccaagatccgcctgtggtaccaacagggggagcggtgcctgtacagcggcaagcccatctccatccaggacctcgtccacaacagcaacaacttcgagatcgaccacatcctgcctctgtccctcagcttcgacgactccctggccaacaaggtgctggtatacgcctggaccaaccaggagaagggccagaagaccccctaccaggtcatcgacagcatggacgcggcctggtccttccgcgagatgaaagactacgtgctcaaccagaaggggatcggcaagaagaagcgggagtatctgctgacgactgagaacatcgacaagatcgaggtcaagaagaagttcatcgagcgcaacttagtcgacacccggtacgccagccgcgtggtgcttaacagcatccaggccgccctgaaggagctcgacaaggacaccaaggtctccgtgatccgggggcagttcaccagccagctgcgccgcaagtggaagatcgacaagtcccgggagacgtaccaccaccacgccgtggacgccttgatcatcgccgcaagctcccagctcaagctgtggcagaagcaggagaaccccatgttcgtagactacggagagaaccaggtggtgaacaaggagaccggggagatccttagcgtctccgacgacgactacaaggagctcgtgttccagcccccgtaccagggcttcgtgaacaccatcagctccaaggccttcgaggacgagatcctgttcagctaccaggtcgactccaaatacaaccgcaaggtgtcggacgcgaccatctactccacgcggaaggcaaagctgggcaaggacaagaaggaagagacctacgtgctcgggaagatcaaggacatctacagccaggacggcttcgatgccttcataaagcgctacaagaaggacaagacccagttcctgatgtaccaaaaggaccccgtcacctgggagaacgtgatcgaagtgatcctgcgggactacccctccgagaagttgagcgaggacgggaagaagaacgtcaagtgcaacccctttgaggagtaccgccgggagaacggcctgatctgcaagtactccaagaagggcaaggggacgccgatcaagagcctgaagtactacgacaagaagctgggcaactgtatcgacatcacccccaaggggagcaagaacgaggtggtgctgcagtccctgaacccctggcgcgccgacctctacttcaaccctgacaccctgaagtacgagctgatgggcctcaagtacagcgatctgtcctttgagaaggggaccggcaagtaccacataagccaggagcggtacgacgagatcaaagtcaaggagggcatcgggaagaactccgagttcaagttcacgctataccgcaacgacctcatcctgatcaaggacaccgagagcggcgaggaggagctgtaccggttcctctcccgcaccatgccgaacgtgaagcactacgttgagcttaagccatacgacaaggagcggtacgacgggggccaggagctgatgaaggtcttcgggaacgtggccaacggcggccagtgcctcaagagcctgaacaagtccaacctgagcatctacaaggtgcgcaccgatgtcctcgggaacaagttcttcatcaagaaggagggcgacaaacccaagctggacttcaagaacaacaagaagtga

SEQ ID NO: 7464 - RNA, 3393 nt, synthetic construct
  misc_feature 1..3393: note = Cas9 variant
  source 1..3393: mol_type = other RNA
atgaccaacggcaagattctggggctcgacatcggcatcgccagcgtgggcgtcggcatcattgaggccaagaccgggaaggttgtgcacgcgaactcccgcctgttcagcgcggccaacgccgagaacaacgccgagcggcgcggcttccggggctcccgacggctgaaccgccggaagaagcatcgcgtcaagcgggtgcgcgacctcttcgagaagtacgggatcgtgacggacttccggaacctgaacctgaacccctacgagctcagagtcaaaggcctgaccgagcagctgaagaacgaggaactgttcgcggccctccggaccataagcaagcgccgggggatctcctacctggacgacgccgaggacgacagcaccggatccactgactacgccaagagcatcgacgaaaaccgccggctcctgaagaacaagaccccggggcaaatccagctggagcgcctcgagaagtacggccagctgcggggcaacttcacagtgtacgacgagaatggggaggcgcaccgcctgatcaacgtgttctcgaccagcgactacgagaaggaggcccggaagatcctcgagacgcaggccgactacaacaagaagatcaccgccgagttcatcgacgactacgtcgagatcctgacccaaaagcgcaagtactaccacggccccgggaacgagaagtcccgcaccgactacggccggttccgcacggacggcaccaccctggagaacatcttcgggatactcatcggtaagtgcaacttctacccagacgagtatcgggccagcaaggcgtcctacaccgcccaagagtataacttcctgaacgatctgaacaacctcaaggtgagcacggagaccgggaagttgtccaccgagcagaaggagagcctggtggagttcgccaagaacaccgccactctcggccccgcgaagctgcttaaggagatcgcgaaaatcctcgattgcaaggtcgacgagatcaaggggtaccgcgaggacgacaagggaaagccggacctgcacaccttcgagccctaccggaagctgaagttcaacttggagtccatcaacatcgacgacctgagccgcgaggtgatcgacaagctggccgacatcctcacactgaacaccgagcgggagggaatcgaggacgccatcaagcgcaacctgcctaaccagttcacggaggagcaaatctccgagataatcaaggtgcgcaaaagccagtccaccgccttcaacaaagggtggcactccttcagcgcgaagctcatgaacgagctgatccctgagctgtacgcgacctccgacgagcagatgaccatccttacgcggctggagaagttcaaggtcaacaagaagtccagcaaaaacaccaagaccatcgacgagaaggaggtgaccgacgaaatctacaacccagtggtcgccaagagcgtgcggcagacgatcaagatcatcaacgccgccgtgaagaagtacggcgacttcgacaagatcgtcatcgagatgccccgcgacaaaaacgccgacgatgagaaaaagttcatcgacaagcggaacaaggagaataagaaggagaaggacgacgcgctgaagcgcgcggcctacctctacaatagtagcgacaagctgcccgacgaggtgttccacgggaacaagcagctggagaccaagattcggctctggtaccagcagggcgagcgctgcctgtactccgggaagcccatcagcatccaggagctggtgcacaacagcaacaacttcgagatcgaccacatcctgccgctcagcctgtcattcgacgacagcctcgccaacaaggtcctagtgtacgcatggaccaaccaggaaaagggccagaagaccccctaccaggtcatcgactccatggacgccgcctggagcttcagggagatgaaggactacgtgctgaagcagaagggcctggggaagaagaagcgcgactacttgctgacgaccgagaacatcgacaagattgaggtgaagaagaagttcatcgagcggaacctggtcgacacccgctacgcatcccgcgttgtgctcaacagcctgcagtccgccctgcgggagctcggcaaggacaccaaggtcagcgtggttcgcgggcagttcaccagccaactgcggcgcaagtggaagatcgacaagtccagggagacctaccaccaccacgcggtcgatgccctgatcatagccgcaagctcccagctgaagctgtgggagaagcaagataaccccatgttcgtggactacggcaagaatcaggtggtcgacaaacagaccggggagatcctgagcgtgtccgacgacgagtacaaggagctcgtgttccaacccccgtaccagggctttgtcaacaccatcagctccaaggggttcgaggacgaaatcctgttcagctaccaggtcgactctaagtacaacagaaaggtgagcgacgcaaccatctactccacgagaaaggcgaagatcgggaaggacaagaaggaagagacctacgttctgggcaagatcaaggacatctactcacagaacgggttcgacaccttcatcaagaagtacaacaaggacaagactcagttcctcatgtaccagaaggactccctgacgtgggagaacgtgatcgaggtaatcctgcgcgactaccccaccaccaaaaagtccgaggacggcaagaacgatgtcaagtgtaaccccttcgaggagtaccggcgcgagaacggcctcatctgcaaatacagcaaaaaggggaaaggcacccccatcaagagcctgaagtactacgacaagaagctgggtaactgtatcgacattacgccggaagagtcccggaacaaggtaatcctccagagcatcaacccatggcgcgccgatgtgtacttcaaccctgagaccctgaagtacgagctgatgggcctcaagtacagcgacctgtccttcgagaaggggaccggtaactaccatatcagccaggagaagtacgacgccatcaaggagaaggagggcatcgggaagaagtccgagttcaagttcaccttgtaccggaacgacctcatcctgatcaaggacatcgccagcggcgagcaggagatctaccgcttcctgtcccggacgatgcccaacgtcaaccactacgtagagctcaagccgtacgacaaggagaagttcgacaacgtgcaggaactggtcgaggcgctgggggaggcagacaaggtgggccggtgcatcaaggggctcaacaagcccaacatcagcatctacaaggtgcggaccgacgtcctgggtaacaagtacttcgtgaagaagaagggcgacaagcccaaactggacttcaagaacaacaagaagtga

SEQ ID NO: 7465 - RNA, 3393 nt, synthetic construct
  misc_feature 1..3393: note = Cas9 variant
  source 1..3393: mol_type = other RNA
atgaccaatggcaagatcctgggcctcgacatcggcatcgcctcggttggggtcggtatcatcgaagccaagaccgggaaggtcgtgcacgccaattctcgcctgttcagcgcagccaacgccgagaacaacgccgagcgccgcggattcagaggcagccgccggctgaaccgccgaaagaagcatcgcgtcaagcgggtgcgcgacctcttcgagaagtacggtatcgtgacggacttccggaacctcaacctgaacccctatgaactccgcgttaagggccttactgagcaacttacgaacgaggaactgttcgcggcgctccggactatctcaaagcgccgggggatctcctacctggacgacgccgaggacgacagcacgggctccaccgactacgctaagagcatcgacgagaaccgccggctcctgaagaccaagaccccggggcagatccagctggaacgcctcgagaaatacggccagctgagaggtaattttacggtgtacgacgagaatggggaggcgcaccgccttatcaacgtgttctccaccagcgactacgagaaggaggcccggaagatcctcgagacccaggccgactacaacaagaagataaccgccgagttcatcgacgattacgtcgagattctgacgcaaaagcggaagtactaccacggccccgggaatgagaagtcccgcaccgactacggacgcttccgcacagatggcacgacactggaaaatatcttcgggatcctcatcggcaagtgcagcttctatcccgacgagtaccgagcctccaaggcgagctacaccgcacaggagtacaacttcctgaacgatcttaacaacctcaaggtacccaccgagaccgggaagctgtccacggagcagaaggaggccctggtggagttcgctaagagcaccgccaccctgggaccggcgaagctgctgaaggagatagccaagatcctcgactgcaaggtcgatgagatcaaggggtatagagaggacgacaagggcaagcccgacctccacacctttgagccctaccggaagctcaaattcaacctcgatagcgtcaacatcgactacctgtcccgcgaggtgctggacaagttggccggcatcctcacgcttaacaccgagcgagaggggatcgaggacgccatcaagcgcaacctccccaaccagttcaccgaggagcagatctctgaaatcatcaacgtccgcaagagccaatcaacggctttcaacaaggggtggcactccttcagcgcgaagttaatgaatgagctgatcccggagctctacgccacgtccgacgagcagatgaccatcctgacccggctcgagaagtttaaggtaaagaagaagtccagcaagaacatcaagaccatcgacgagaaggagatcacggacgaaatctacaatcccgtcgtcgcaaagagcgtgcgacagaccattaagatcatcaacgccgccgtgaagaagtacggggatttcgataagatcgtcatcgagatgccccgagacaagaacgcggacgacgagaagaagttcatcaacaagcggaataaggagaacaagaaggagaaggacgacgcactcaagcgcgccgcatatttgtacaacggcaccgacaaactgcccgacgaggtgttccacggaaataagcagctcgagaccaaaattcggctgtggtaccagcaaggcgagcgctgcctgtactccggcaagccgatccccatccaggagctggtgcacaacagtaacaacttcgagatcgatcacattttgcccttgagtctgagcttcgacgactcccttgcgaacaaggtcctggtgtacagctggacgaaccaggagaaggggcagaagacgccctaccaggtcatcgactccatggatgccgcctggtcattccgcgaaatgaaggagtacgtactgaagcagaagggcctcgggaagaagaagcgcgactacctgctgaccaccgagaacatcgacaagatcgaggtgaagaagaagttcatcgagcggaacctcgtcgacacccgctacgcctcccgcgtggtgcttaacagcctgcagtccgcactccgggagctgggcaaagacacgaaagtcagcgtggtgcgcgggcagtttacctcccagctgcggcgtaagtggaagattgacaagagccgggagacctaccaccaccacgcggtcgacgccctcatcatcgcagcctcctcccagctgaaactttgggaaaagcaagacaacccgatgttcgtggactacggcaataaccaagtggtcgacaagcagaccggcgagatcctcagcgtttcagacaacgagtacaaggagttagtgttccagccgccctaccaggggttcgtcaacacgatcagctccaagggcttcgaggacgagatcctgttcagctaccaggtggactccaagtacaaccgcaaggtgtctgacgccactatctattccacccggaaggcgaagatcggcaaggacaagaaggaggagacctacgtcctcggcaagatcaaggacatctacagccagaacggcttcgacacgttcgtgaagaagtacaacaaggacaagacccagttcctgatgtaccagaaggaccccctgacctgggagaacgtgatagaggtcatcctcggggactacccgacgacgaagaagtccgaagatggaaagaacgacgtgaagtgcaacccattcgaggagtaccgccgggaaaacggactgatatgtaaatacagcaagaaggggaaggggacaccgatcaagtccctgaagtactacgacaagaagctcggcaattgcatcgacatcacccccgaggagagccgaaataaggtgatcctacagtccatcaacccctggagagccgacgtctacttcaaccccgagaccctgaagtacgagctcatgggcctgaagtacagcgacctgtccttcgagaaggggacgggcaactaccacatcagccaggagaagtacgacgccataaaggagaaggagggaatcggcaagaaatccgagttcaagttcaccctctaccgcaacgacctcatcctgatcaaggatatcgccagcggtgagcaggaaatttacagattcctcagccgcaccatgcccaacgtgaaccactacgtagagctcaaaccctacgataaggagaagttcgacaacgtgcaggagctggtggaagccctcggggaagcggacaaggtgggccgctgcatcaaggggctgaacaagccgaacatttccatctataaggtccgcaccgacgtactgggcaacaagtacttcgtgaagaaagagggggacaagcccaagctcgacttcaaaaacaacaagaagtga
